United States Patent 11,535,835 (COMPOSITIONS AND METHODS FOR THE TARGETING OF RHODOPSIN) - sequence listing, part 2

SEQ ID NO: 20217 - RNA, 20 nt, Artificial Sequence
  targeting sequence with TTCN PAM
uugcaugauccaauuuuggg

SEQ ID NO: 20218 - RNA, 20 nt, Artificial Sequence
  targeting sequence with TTCN PAM
ucuccucuguggcucacugu

SEQ ID NO: 20219 - RNA, 20 nt, Artificial Sequence
  targeting sequence with TTCN PAM
cacccccagccagucaccca

SEQ ID NO: 20220 - RNA, 20 nt, Artificial Sequence
  targeting sequence with TTCN PAM
aaagugggugacuggcuggg

SEQ ID NO: 20221 - RNA, 20 nt, Artificial Sequence
  targeting sequence with TTCN PAM
uggcuucaaaagugggugac

SEQ ID NO: 20222 - RNA, 20 nt, Artificial Sequence
  targeting sequence with TTCN PAM
ccacaggcuuucaucagagu

SEQ ID NO: 20223 - RNA, 20 nt, Artificial Sequence
  targeting sequence with TTCN PAM
ucagaguacaagaccucauc

SEQ ID NO: 20224 - RNA, 20 nt, Artificial Sequence
  targeting sequence with TTCN PAM
acuuuuaccucaaugcugcu

SEQ ID NO: 20225 - RNA, 20 nt, Artificial Sequence
  targeting sequence with TTCN PAM
uacuugucaagaaaguggac

SEQ ID NO: 20226 - RNA, 20 nt, Artificial Sequence
  targeting sequence with TTCN PAM
ugacaaguaagaaugcuuca

SEQ ID NO: 20227 - RNA, 20 nt, Artificial Sequence
  targeting sequence with TTCN PAM
ggguucaggggcagcccuug

SEQ ID NO: 20228 - RNA, 20 nt, Artificial Sequence
  targeting sequence with TTCN PAM
ggggcagcccuuguggcagg

SEQ ID NO: 20229 - RNA, 20 nt, Artificial Sequence
  targeting sequence with TTCN PAM
uuuucacgcugcuggaaaag

SEQ ID NO: 20230 - RNA, 20 nt, Artificial Sequence
  targeting sequence with TTCN PAM
cgcugcuggaaaagauguac

SEQ ID NO: 20231 - RNA, 20 nt, Artificial Sequence
  targeting sequence with TTCN PAM
agcagcgugaaaaugaacua

SEQ ID NO: 20232 - RNA, 20 nt, Artificial Sequence
  targeting sequence with TTCN PAM
uuuguaaauugcccagucuc

SEQ ID NO: 20233 - RNA, 20 nt, Artificial Sequence
  targeting sequence with TTCN PAM
acauggcuaaggaagccuca

SEQ ID NO: 20234 - RNA, 20 nt, Artificial Sequence
  targeting sequence with TTCN PAM
uuagccauguggaacugcaa

SEQ ID NO: 20235 - RNA, 20 nt, Artificial Sequence
  targeting sequence with TTCN PAM
gccaugaucaugaggcuucc

SEQ ID NO: 20236 - RNA, 20 nt, Artificial Sequence
  targeting sequence with TTCN PAM
uugccuucugccaugaucau

SEQ ID NO: 20237 - RNA, 20 nt, Artificial Sequence
  targeting sequence with TTCN PAM
ccugcacaagcucucuguuu

SEQ ID NO: 20238 - RNA, 20 nt, Artificial Sequence
  targeting sequence with TTCN PAM
caugauaguaagucucacga

SEQ ID NO: 20239 - RNA, 20 nt, Artificial Sequence
  targeting sequence with TTCN PAM
caugcuguucucaugauagu

SEQ ID NO: 20240 - RNA, 20 nt, Artificial Sequence
  targeting sequence with TTCN PAM
auuacccgccacgggguccc

SEQ ID NO: 20241 - RNA, 20 nt, Artificial Sequence
  targeting sequence with TTCN PAM
cauguguugugggagggacc

SEQ ID NO: 20242 - RNA, 20 nt, Artificial Sequence
  targeting sequence with TTCN PAM
agaugagaucugggugggga

SEQ ID NO: 20243 - RNA, 20 nt, Artificial Sequence
  targeting sequence with TTCN PAM
cgaucucuccaggguugggu

SEQ ID NO: 20244 - RNA, 20 nt, Artificial Sequence
  targeting sequence with TTCN PAM
ugucugugaaaagggauugg

SEQ ID NO: 20245 - RNA, 20 nt, Artificial Sequence
  targeting sequence with TTCN PAM
cagacaagaaacccaacccu

SEQ ID NO: 20246 - RNA, 20 nt, Artificial Sequence
  targeting sequence with TTCN PAM
guagguucucaggaacuggu

SEQ ID NO: 20247 - RNA, 20 nt, Artificial Sequence
  targeting sequence with TTCN PAM
caggaacugguuugcauccu

SEQ ID NO: 20248 - RNA, 20 nt, Artificial Sequence
  targeting sequence with TTCN PAM
ugagaaccuacugaauccuc

SEQ ID NO: 20249 - RNA, 20 nt, Artificial Sequence
  targeting sequence with TTCN PAM
caaaugcacaugagcugagc

SEQ ID NO: 20250 - RNA, 20 nt, Artificial Sequence
  targeting sequence with TTCN PAM
ccagaaauggaccuggggag

SEQ ID NO: 20251 - RNA, 20 nt, Artificial Sequence
  targeting sequence with TTCN PAM
ggggaauggagcucagcuca

SEQ ID NO: 20252 - RNA, 20 nt, Artificial Sequence
  targeting sequence with TTCN PAM
gacugugggccuugcucccc

SEQ ID NO: 20253 - RNA, 20 nt, Artificial Sequence
  targeting sequence with TTCN PAM
ggagcaacucccagcccuac

SEQ ID NO: 20254 - RNA, 20 nt, Artificial Sequence
  targeting sequence with TTCN PAM
uggcugagaauauucaguuu

SEQ ID NO: 20255 - RNA, 20 nt, Artificial Sequence
  targeting sequence with TTCN PAM
cagccaggaacaguagggcu

SEQ ID NO: 20256 - RNA, 20 nt, Artificial Sequence
  targeting sequence with TTCN PAM
guuugucauccaacccaaua

SEQ ID NO: 20257 - RNA, 20 nt, Artificial Sequence
  targeting sequence with TTCN PAM
uuagcccacugcaggccuau

SEQ ID NO: 20258 - RNA, 20 nt, Artificial Sequence
  targeting sequence with TTCN PAM
uuuuauucuuuuuuuuuuuu

SEQ ID NO: 20259 - RNA, 20 nt, Artificial Sequence
  targeting sequence with TTCN PAM
aacaggcugccaguucugac

SEQ ID NO: 20260 - RNA, 20 nt, Artificial Sequence
  targeting sequence with TTCN PAM
ucaccccacacccauuucca

SEQ ID NO: 20261 - RNA, 20 nt, Artificial Sequence
  targeting sequence with TTCN PAM
ccccacacccauuuccaucc

SEQ ID NO: 20262 - RNA, 20 nt, Artificial Sequence
  targeting sequence with TTCN PAM
aucccaggaccacacaccuu

SEQ ID NO: 20263 - RNA, 20 nt, Artificial Sequence
  targeting sequence with TTCN PAM
uccggcaccagucagaccga

SEQ ID NO: 20264 - RNA, 20 nt, Artificial Sequence
  targeting sequence with TTCN PAM
ugguucucuuuuugacgauc

SEQ ID NO: 20265 - RNA, 20 nt, Artificial Sequence
  targeting sequence with TTCN PAM
cuuuuugacgaucuugggcu

SEQ ID NO: 20266 - RNA, 20 nt, Artificial Sequence
  targeting sequence with TTCN PAM
caagggaucugagggcagcc

SEQ ID NO: 20267 - RNA, 20 nt, Artificial Sequence
  targeting sequence with TTCN PAM
ccaaaaggcaucauggcugc

SEQ ID NO: 20268 - RNA, 20 nt, Artificial Sequence
  targeting sequence with TTCN PAM
uccccaaaaggcaucauggc

SEQ ID NO: 20269 - RNA, 20 nt, Artificial Sequence
  targeting sequence with TTCN PAM
ucaccuggggcuacuucuuc

SEQ ID NO: 20270 - RNA, 20 nt, Artificial Sequence
  targeting sequence with TTCN PAM
uccucaccuggggcuacuuc

SEQ ID NO: 20271 - RNA, 20 nt, Artificial Sequence
  targeting sequence with TTCN PAM
aggauucuuccucaccuggg

SEQ ID NO: 20272 - RNA, 20 nt, Artificial Sequence
  targeting sequence with TTCN PAM
cgcccagggacugaacacug

SEQ ID NO: 20273 - RNA, 20 nt, Artificial Sequence
  targeting sequence with TTCN PAM
gucccugggcgggaaagccu

SEQ ID NO: 20274 - RNA, 20 nt, Artificial Sequence
  targeting sequence with TTCN PAM
aaucaccagcuacggagcaa

SEQ ID NO: 20275 - RNA, 20 nt, Artificial Sequence
  targeting sequence with TTCN PAM
cagcuugcuccguagcuggu

SEQ ID NO: 20276 - RNA, 20 nt, Artificial Sequence
  targeting sequence with TTCN PAM
auucccagcuugcuccguag

SEQ ID NO: 20277 - RNA, 20 nt, Artificial Sequence
  targeting sequence with TTCN PAM
cucccuuuccgaagcuggca

SEQ ID NO: 20278 - RNA, 20 nt, Artificial Sequence
  targeting sequence with TTCN PAM
gaagcuggcagaauacuagg

SEQ ID NO: 20279 - RNA, 20 nt, Artificial Sequence
  targeting sequence with TTCN PAM
gaaagggagggaaagcaagc

SEQ ID NO: 20280 - RNA, 20 nt, Artificial Sequence
  targeting sequence with TTCN PAM
gccagcuucggaaagggagg

SEQ ID NO: 20281 - RNA, 20 nt, Artificial Sequence
  targeting sequence with TTCN PAM
uugggcucugagugggugag

SEQ ID NO: 20282 - RNA, 20 nt, Artificial Sequence
  targeting sequence with TTCN PAM
gacacuggcagggugggauu

SEQ ID NO: 20283 - RNA, 20 nt, Artificial Sequence
  targeting sequence with TTCN PAM
gguaguacuggccuugacca

SEQ ID NO: 20284 - RNA, 20 nt, Artificial Sequence
  targeting sequence with TTCN PAM
aguagauggucaaggccagu

SEQ ID NO: 20285 - RNA, 20 nt, Artificial Sequence
  targeting sequence with TTCN PAM
ucaccuguaaaauggagacg

SEQ ID NO: 20286 - RNA, 20 nt, Artificial Sequence
  targeting sequence with TTCN PAM
gcacacaaugucgucuccau

SEQ ID NO: 20287 - RNA, 20 nt, Artificial Sequence
  targeting sequence with TTCN PAM
auaaagaaaaccuucuaauu

SEQ ID NO: 20288 - RNA, 20 nt, Artificial Sequence
  targeting sequence with TTCN PAM
uuauugaacauuuacccugu

SEQ ID NO: 20289 - RNA, 20 nt, Artificial Sequence
  targeting sequence with TTCN PAM
aauucccuagguagcagcug

SEQ ID NO: 20290 - RNA, 20 nt, Artificial Sequence
  targeting sequence with TTCN PAM
cuagguagcagcugcgcuac

SEQ ID NO: 20291 - RNA, 20 nt, Artificial Sequence
  targeting sequence with TTCN PAM
auuaucaacucacaacuucc

SEQ ID NO: 20292 - RNA, 20 nt, Artificial Sequence
  targeting sequence with TTCN PAM
ucaguguggucuucugagcc

SEQ ID NO: 20293 - RNA, 20 nt, Artificial Sequence
  targeting sequence with TTCN PAM
gagccauucauuuauuuccu

SEQ ID NO: 20294 - RNA, 20 nt, Artificial Sequence
  targeting sequence with TTCN PAM
uuuauuuccuacagcagcac

SEQ ID NO: 20295 - RNA, 20 nt, Artificial Sequence
  targeting sequence with TTCN PAM
uacagcagcaccccuucugu

SEQ ID NO: 20296 - RNA, 20 nt, Artificial Sequence
  targeting sequence with TTCN PAM
guucucuuugcagccaucag

SEQ ID NO: 20297 - RNA, 20 nt, Artificial Sequence
  targeting sequence with TTCN PAM
cuuugcagccaucaguuggc

SEQ ID NO: 20298 - RNA, 20 nt, Artificial Sequence
  targeting sequence with TTCN PAM
uugaguacccacucugugcc

SEQ ID NO: 20299 - RNA, 20 nt, Artificial Sequence
  targeting sequence with TTCN PAM
aaacaacuuugccuucuggc

SEQ ID NO: 20300 - RNA, 20 nt, Artificial Sequence
  targeting sequence with TTCN PAM
ggcccaugauauccuugaag

SEQ ID NO: 20301 - RNA, 20 nt, Artificial Sequence
  targeting sequence with TTCN PAM
aggauaucaugggccagaag

SEQ ID NO: 20302 - RNA, 20 nt, Artificial Sequence
  targeting sequence with TTCN PAM
cccuugccuucaaggauauc

SEQ ID NO: 20303 - RNA, 20 nt, Artificial Sequence
  targeting sequence with TTCN PAM
ucuuuauauucccagagcuc

SEQ ID NO: 20304 - RNA, 20 nt, Artificial Sequence
  targeting sequence with TTCN PAM
cagagcuccugacgaucaaa

SEQ ID NO: 20305 - RNA, 20 nt, Artificial Sequence
  targeting sequence with TTCN PAM
agccugugacccuagggcug

SEQ ID NO: 20306 - RNA, 20 nt, Artificial Sequence
  targeting sequence with TTCN PAM
uucuagccugugacccuagg

SEQ ID NO: 20307 - RNA, 20 nt, Artificial Sequence
  targeting sequence with TTCN PAM
uuuccuucuagccugugacc

SEQ ID NO: 20308 - RNA, 20 nt, Artificial Sequence
  targeting sequence with TTCN PAM
uugccaugaccccacguucc

SEQ ID NO: 20309 - RNA, 20 nt, Artificial Sequence
  targeting sequence with TTCN PAM
uucauugccaugaccccacg

SEQ ID NO: 20310 - RNA, 20 nt, Artificial Sequence
  targeting sequence with TTCN PAM
guuuauaccgugcuuacuga

SEQ ID NO: 20311 - RNA, 20 nt, Artificial Sequence
  targeting sequence with TTCN PAM
aagccccccacccaacugaa

SEQ ID NO: 20312 - RNA, 20 nt, Artificial Sequence
  targeting sequence with TTCN PAM
guuggguggggggcuuagaa

SEQ ID NO: 20313 - RNA, 20 nt, Artificial Sequence
  targeting sequence with TTCN PAM
aaaguuaaccugaaaaacua

SEQ ID NO: 20314 - RNA, 20 nt, Artificial Sequence
  targeting sequence with TTCN PAM
gguuaacuuuggaaugcccu

SEQ ID NO: 20315 - RNA, 20 nt, Artificial Sequence
  targeting sequence with TTCN PAM
agccauaaugggaauguggg

SEQ ID NO: 20316 - RNA, 20 nt, Artificial Sequence
  targeting sequence with TTCN PAM
cauuauggcuugaacuaguu

SEQ ID NO: 20317 - RNA, 20 nt, Artificial Sequence
  targeting sequence with TTCN PAM
accccacauucccauuaugg

SEQ ID NO: 20318 - RNA, 20 nt, Artificial Sequence
  targeting sequence with TTCN PAM
cccuauggaauucaggcaca

SEQ ID NO: 20319 - RNA, 20 nt, Artificial Sequence
  targeting sequence with TTCN PAM
auagggagaagggcauaaug

SEQ ID NO: 20320 - RNA, 20 nt, Artificial Sequence
  targeting sequence with TTCN PAM
ggcacagcugaccagcguua

SEQ ID NO: 20321 - RNA, 20 nt, Artificial Sequence
  targeting sequence with TTCN PAM
accugacucuaguauagcau

SEQ ID NO: 20322 - RNA, 20 nt, Artificial Sequence
  targeting sequence with TTCN PAM
gggccugcaaucugucaugu

SEQ ID NO: 20323 - RNA, 20 nt, Artificial Sequence
  targeting sequence with TTCN PAM
uucagggccugcaaucuguc

SEQ ID NO: 20324 - RNA, 20 nt, Artificial Sequence
  targeting sequence with TTCN PAM
guuucuuucagggccugcaa

SEQ ID NO: 20325 - RNA, 20 nt, Artificial Sequence
  targeting sequence with TTCN PAM
uugacauauucugacauggc

SEQ ID NO: 20326 - RNA, 20 nt, Artificial Sequence
  targeting sequence with TTCN PAM
gacauggcccuguaaagcug

SEQ ID NO: 20327 - RNA, 20 nt, Artificial Sequence
  targeting sequence with TTCN PAM
cuacaggacguagauugucc

SEQ ID NO: 20328 - RNA, 20 nt, Artificial Sequence
  targeting sequence with TTCN PAM
aggucuucucccugagccag

SEQ ID NO: 20329 - RNA, 20 nt, Artificial Sequence
  targeting sequence with TTCN PAM
cccugagccaggagaggcuc

SEQ ID NO: 20330 - RNA, 20 nt, Artificial Sequence
  targeting sequence with TTCN PAM
ggccugguaagaaacauuua

SEQ ID NO: 20331 - RNA, 20 nt, Artificial Sequence
  targeting sequence with TTCN PAM
uaccaggccugaaaaggugc

SEQ ID NO: 20332 - RNA, 20 nt, Artificial Sequence
  targeting sequence with TTCN PAM
aagagaguagaucguaaaug

SEQ ID NO: 20333 - RNA, 20 nt, Artificial Sequence
  targeting sequence with TTCN PAM
ucugcauaaauaagaaccuu

SEQ ID NO: 20334 - RNA, 20 nt, Artificial Sequence
  targeting sequence with TTCN PAM
uauuuaugcagaggaagccu

SEQ ID NO: 20335 - RNA, 20 nt, Artificial Sequence
  targeting sequence with TTCN PAM
gauaagagguuguggagacc

SEQ ID NO: 20336 - RNA, 20 nt, Artificial Sequence
  targeting sequence with TTCN PAM
uuuuuguugauuccaagucu

SEQ ID NO: 20337 - RNA, 20 nt, Artificial Sequence
  targeting sequence with TTCN PAM
aagucuuuagacaaacucaa

SEQ ID NO: 20338 - RNA, 20 nt, Artificial Sequence
  targeting sequence with TTCN PAM
caggacuuccugagggcuuu

SEQ ID NO: 20339 - RNA, 20 nt, Artificial Sequence
  targeting sequence with TTCN PAM
ugagggcuuugucacgggcc

SEQ ID NO: 20340 - RNA, 20 nt, Artificial Sequence
  targeting sequence with TTCN PAM
gaguccaguaugagugacca

SEQ ID NO: 20341 - RNA, 20 nt, Artificial Sequence
  targeting sequence with TTCN PAM
aauacuuuacacaguuugac

SEQ ID NO: 20342 - RNA, 20 nt, Artificial Sequence
  targeting sequence with TTCN PAM
ucaauagacgcaaagcccaa

SEQ ID NO: 20343 - RNA, 20 nt, Artificial Sequence
  targeting sequence with TTCN PAM
cucuguucguguacgcgcuc

SEQ ID NO: 20344 - RNA, 20 nt, Artificial Sequence
  targeting sequence with TTCN PAM
uguacgcgcuccagcaagcc

SEQ ID NO: 20345 - RNA, 20 nt, Artificial Sequence
  targeting sequence with TTCN PAM
cuaccacucugugucugugg

SEQ ID NO: 20346 - RNA, 20 nt, Artificial Sequence
  targeting sequence with TTCN PAM
ucuggcccuaugguccccug

SEQ ID NO: 20347 - RNA, 20 nt, Artificial Sequence
  targeting sequence with TTCN PAM
ugcaggcuucaucuggcccu

SEQ ID NO: 20348 - RNA, 20 nt, Artificial Sequence
  targeting sequence with TTCN PAM
gggauuacaggcgugagcca

SEQ ID NO: 20349 - RNA, 20 nt, Artificial Sequence
  targeting sequence with TTCN PAM
aaaguucugggauuacaggc

SEQ ID NO: 20350 - RNA, 20 nt, Artificial Sequence
  targeting sequence with TTCN PAM
agaccagccuggccaacaua

SEQ ID NO: 20351 - RNA, 20 nt, Artificial Sequence
  targeting sequence with TTCN PAM
cuauguuggccaggcugguc

SEQ ID NO: 20352 - RNA, 20 nt, Artificial Sequence
  targeting sequence with TTCN PAM
aaaauuagccaggcguggug

SEQ ID NO: 20353 - RNA, 20 nt, Artificial Sequence
  targeting sequence with TTCN PAM
ccugccucagccugccaagu

SEQ ID NO: 20354 - RNA, 20 nt, Artificial Sequence
  targeting sequence with TTCN PAM
agcgauucuccugccucagc

SEQ ID NO: 20355 - RNA, 20 nt, Artificial Sequence
  targeting sequence with TTCN PAM
gggguucaagcgauucuccu

SEQ ID NO: 20356 - RNA, 20 nt, Artificial Sequence
  targeting sequence with TTCN PAM
caggcuggagugcaguggug

SEQ ID NO: 20357 - RNA, 20 nt, Artificial Sequence
  targeting sequence with TTCN PAM
ugcucggugaguuuguuugu

SEQ ID NO: 20358 - RNA, 20 nt, Artificial Sequence
  targeting sequence with TTCN PAM
uuuuccugcucggugaguuu

SEQ ID NO: 20359 - RNA, 20 nt, Artificial Sequence
  targeting sequence with TTCN PAM
uuggugcuucuuuuuccugc

SEQ ID NO: 20360 - RNA, 20 nt, Artificial Sequence
  targeting sequence with TTCN PAM
cucuuccuuggugcuucuuu

SEQ ID NO: 20361 - RNA, 20 nt, Artificial Sequence
  targeting sequence with TTCN PAM
cugucaggacccagagguua

SEQ ID NO: 20362 - RNA, 20 nt, Artificial Sequence
  targeting sequence with TTCN PAM
ggcuccggguccuuaaaaaa

SEQ ID NO: 20363 - RNA, 20 nt, Artificial Sequence
  targeting sequence with TTCN PAM
uugacaugucuuuuuuuuaa

SEQ ID NO: 20364 - RNA, 20 nt, Artificial Sequence
  targeting sequence with TTCN PAM
gcagcacucuuucuuugaca

SEQ ID NO: 20365 - RNA, 20 nt, Artificial Sequence
  targeting sequence with TTCN PAM
gcauuucugcagcacucuuu

SEQ ID NO: 20366 - RNA, 20 nt, Artificial Sequence
  targeting sequence with TTCN PAM
uagauauuacucucuauuaa

SEQ ID NO: 20367 - RNA, 20 nt, Artificial Sequence
  targeting sequence with TTCN PAM
uuuacauucuuagauauuac

SEQ ID NO: 20368 - RNA, 20 nt, Artificial Sequence
  targeting sequence with TTCN PAM
aacuagugccaagggcaggu

SEQ ID NO: 20369 - RNA, 20 nt, Artificial Sequence
  targeting sequence with TTCN PAM
aacuuucuaacuagugccaa

SEQ ID NO: 20370 - RNA, 20 nt, Artificial Sequence
  targeting sequence with TTCN PAM
uucugaguugagaccuggug

SEQ ID NO: 20371 - RNA, 20 nt, Artificial Sequence
  targeting sequence with TTCN PAM
gaguugagaccugguguagg

SEQ ID NO: 20372 - RNA, 20 nt, Artificial Sequence
  targeting sequence with TTCN PAM
ucccuacaccaggucucaac

SEQ ID NO: 20373 - RNA, 20 nt, Artificial Sequence
  targeting sequence with TTCN PAM
gccagaaguugaagccaauc

SEQ ID NO: 20374 - RNA, 20 nt, Artificial Sequence
  targeting sequence with TTCN PAM
ggcggaaguagauuccuccc

SEQ ID NO: 20375 - RNA, 20 nt, Artificial Sequence
  targeting sequence with TTCN PAM
acuucuggcggaaguagauu

SEQ ID NO: 20376 - RNA, 20 nt, Artificial Sequence
  targeting sequence with TTCN PAM
gcccuuguuuccucuacucc

SEQ ID NO: 20377 - RNA, 20 nt, Artificial Sequence
  targeting sequence with TTCN PAM
ucuacuccgaagugcgcuuc

SEQ ID NO: 20378 - RNA, 20 nt, Artificial Sequence
  targeting sequence with TTCN PAM
gaguagaggaaacaagggcg

SEQ ID NO: 20379 - RNA, 20 nt, Artificial Sequence
  targeting sequence with TTCN PAM
uagcggucaggagagaucaa

SEQ ID NO: 20380 - RNA, 20 nt, Artificial Sequence
  targeting sequence with TTCN PAM
caaaauucccucacugaauu

SEQ ID NO: 20381 - RNA, 20 nt, Artificial Sequence
  targeting sequence with TTCN PAM
cucacugaauuuacauagua

SEQ ID NO: 20382 - RNA, 20 nt, Artificial Sequence
  targeting sequence with TTCN PAM
gugagggaauuuugggaagu

SEQ ID NO: 20383 - RNA, 20 nt, Artificial Sequence
  targeting sequence with TTCN PAM
ggucucaucacuauuuacua

SEQ ID NO: 20384 - RNA, 20 nt, Artificial Sequence
  targeting sequence with TTCN PAM
auaauguaaccuauuauugu

SEQ ID NO: 20385 - RNA, 20 nt, Artificial Sequence
  targeting sequence with TTCN PAM
acauaugcaaaauagagaca

SEQ ID NO: 20386 - RNA, 20 nt, Artificial Sequence
  targeting sequence with TTCN PAM
ccuuccacauaugcaaaaua

SEQ ID NO: 20387 - RNA, 20 nt, Artificial Sequence
  targeting sequence with TTCN PAM
aaccauuagucuaaacuacc

SEQ ID NO: 20388 - RNA, 20 nt, Artificial Sequence
  targeting sequence with TTCN PAM
cagcuacugucuaauuuuua

SEQ ID NO: 20389 - RNA, 20 nt, Artificial Sequence
  targeting sequence with TTCN PAM
ugauuugcuuagcuuuuuuu

SEQ ID NO: 20390 - RNA, 20 nt, Artificial Sequence
  targeting sequence with TTCN PAM
gccucccagguucaagggac

SEQ ID NO: 20391 - RNA, 20 nt, Artificial Sequence
  targeting sequence with TTCN PAM
agggacaagggauucuccug

SEQ ID NO: 20392 - RNA, 20 nt, Artificial Sequence
  targeting sequence with TTCN PAM
ccugccucaggcuccguagu

SEQ ID NO: 20393 - RNA, 20 nt, Artificial Sequence
  targeting sequence with TTCN PAM
guagagacaagggucucacu

SEQ ID NO: 20394 - RNA, 20 nt, Artificial Sequence
  targeting sequence with TTCN PAM
ccugagacaacugggacucu

SEQ ID NO: 20395 - RNA, 20 nt, Artificial Sequence
  targeting sequence with TTCN PAM
uuccuuguggaguuagauga

SEQ ID NO: 20396 - RNA, 20 nt, Artificial Sequence
  targeting sequence with TTCN PAM
uuguggaguuagaugauugc

SEQ ID NO: 20397 - RNA, 20 nt, Artificial Sequence
  targeting sequence with TTCN PAM
ucaaacuccuuaaagcgcau

SEQ ID NO: 20398 - RNA, 20 nt, Artificial Sequence
  targeting sequence with TTCN PAM
ugcuuuucuuuggcguuuuc

SEQ ID NO: 20399 - RNA, 20 nt, Artificial Sequence
  targeting sequence with TTCN PAM
uuggcguuuuccuaguggag

SEQ ID NO: 20400 - RNA, 20 nt, Artificial Sequence
  targeting sequence with TTCN PAM
uaguggagaagagagaggca

SEQ ID NO: 20401 - RNA, 20 nt, Artificial Sequence
  targeting sequence with TTCN PAM
ccacuaggaaaacgccaaag

SEQ ID NO: 20402 - RNA, 20 nt, Artificial Sequence
  targeting sequence with TTCN PAM
acucuccucacaaaaugccu

SEQ ID NO: 20403 - RNA, 20 nt, Artificial Sequence
  targeting sequence with TTCN PAM
uauguaaaggggccuaguag

SEQ ID NO: 20404 - RNA, 20 nt, Artificial Sequence
  targeting sequence with TTCN PAM
cugagucuuagcaucuucau

SEQ ID NO: 20405 - RNA, 20 nt, Artificial Sequence
  targeting sequence with TTCN PAM
guuaaauggacaaggcacuu

SEQ ID NO: 20406 - RNA, 20 nt, Artificial Sequence
  targeting sequence with TTCN PAM
ggccacacacccagugggca

SEQ ID NO: 20407 - RNA, 20 nt, Artificial Sequence
  targeting sequence with TTCN PAM
agaccccugccagcugccca

SEQ ID NO: 20408 - RNA, 20 nt, Artificial Sequence
  targeting sequence with TTCN PAM
ucugcagucacccacggaug

SEQ ID NO: 20409 - RNA, 20 nt, Artificial Sequence
  targeting sequence with TTCN PAM
uagagaagacucagguuggc

SEQ ID NO: 20410 - RNA, 20 nt, Artificial Sequence
  targeting sequence with TTCN PAM
cuaagaaaauggccuccuuu

SEQ ID NO: 20411 - RNA, 20 nt, Artificial Sequence
  targeting sequence with TTCN PAM
agaggccaaccugagucuuc

SEQ ID NO: 20412 - RNA, 20 nt, Artificial Sequence
  targeting sequence with TTCN PAM
ccgggaccugccuccagccc

SEQ ID NO: 20413 - RNA, 20 nt, Artificial Sequence
  targeting sequence with TTCN PAM
uuuauccuccuaugagcugc

SEQ ID NO: 20414 - RNA, 20 nt, Artificial Sequence
  targeting sequence with TTCN PAM
uuguuaaaaaacaagguggu

SEQ ID NO: 20415 - RNA, 20 nt, Artificial Sequence
  targeting sequence with TTCN PAM
aaaaccagaaucagcaaaga

SEQ ID NO: 20416 - RNA, 20 nt, Artificial Sequence
  targeting sequence with TTCN PAM
gguuuuagaagcuuuaaaag

SEQ ID NO: 20417 - RNA, 20 nt, Artificial Sequence
  targeting sequence with TTCN PAM
ugcugcaacacagagcugag

SEQ ID NO: 20418 - RNA, 20 nt, Artificial Sequence
  targeting sequence with TTCN PAM
agcuacucaggaagcugaag

SEQ ID NO: 20419 - RNA, 20 nt, Artificial Sequence
  targeting sequence with TTCN PAM
ugaguagcuagaaccacagg

SEQ ID NO: 20420 - RNA, 20 nt, Artificial Sequence
  targeting sequence with TTCN PAM
gcuuccugaguagcuagaac

SEQ ID NO: 20421 - RNA, 20 nt, Artificial Sequence
  targeting sequence with TTCN PAM
ugggcauaagcaauccuccc

SEQ ID NO: 20422 - RNA, 20 nt, Artificial Sequence
  targeting sequence with TTCN PAM
caggugugaucauagcuuac

SEQ ID NO: 20423 - RNA, 20 nt, Artificial Sequence
  targeting sequence with TTCN PAM
cuccagccuaggcaacauaa

SEQ ID NO: 20424 - RNA, 20 nt, Artificial Sequence
  targeting sequence with TTCN PAM
cuuggcuucccacagcauuu

SEQ ID NO: 20425 - RNA, 20 nt, Artificial Sequence
  targeting sequence with TTCN PAM
cacagcauuuagaccaaaac

SEQ ID NO: 20426 - RNA, 20 nt, Artificial Sequence
  targeting sequence with TTCN PAM
caccugguccauggcauacc

SEQ ID NO: 20427 - RNA, 20 nt, Artificial Sequence
  targeting sequence with TTCN PAM
cccuucacccauuccaccca

SEQ ID NO: 20428 - RNA, 20 nt, Artificial Sequence
  targeting sequence with TTCN PAM
cccauuccacccagccaccc

SEQ ID NO: 20429 - RNA, 20 nt, Artificial Sequence
  targeting sequence with TTCN PAM
acccagccacccugaccacc

SEQ ID NO: 20430 - RNA, 20 nt, Artificial Sequence
  targeting sequence with TTCN PAM
gucucuugcaagcuauccua

SEQ ID NO: 20431 - RNA, 20 nt, Artificial Sequence
  targeting sequence with TTCN PAM
caguucuaucugccuagauu

SEQ ID NO: 20432 - RNA, 20 nt, Artificial Sequence
  targeting sequence with TTCN PAM
aucugccuagauugugcuuc

SEQ ID NO: 20433 - RNA, 20 nt, Artificial Sequence
  targeting sequence with TTCN PAM
cccaagacuaguuccuguca

SEQ ID NO: 20434 - RNA, 20 nt, Artificial Sequence
  targeting sequence with TTCN PAM
ugucaaucacucagauguca

SEQ ID NO: 20435 - RNA, 20 nt, Artificial Sequence
  targeting sequence with TTCN PAM
cagagaggccgucccugacc

SEQ ID NO: 20436 - RNA, 20 nt, Artificial Sequence
  targeting sequence with TTCN PAM
augagcuugcaccuaaaggg

SEQ ID NO: 20437 - RNA, 20 nt, Artificial Sequence
  targeting sequence with TTCN PAM
caguuucuagaaguggcaca

SEQ ID NO: 20438 - RNA, 20 nt, Artificial Sequence
  targeting sequence with TTCN PAM
agaaguggcacauaguaguu

SEQ ID NO: 20439 - RNA, 20 nt, Artificial Sequence
  targeting sequence with TTCN PAM
agaaacugggaacacagcag

SEQ ID NO: 20440 - RNA, 20 nt, Artificial Sequence
  targeting sequence with TTCN PAM
aaugaaugaaagaaucccau

SEQ ID NO: 20441 - RNA, 20 nt, Artificial Sequence
  targeting sequence with TTCN PAM
uuggaaucuuuguugagcaa

SEQ ID NO: 20442 - RNA, 20 nt, Artificial Sequence
  targeting sequence with TTCN PAM
uucauuggaaucuuuguuga

SEQ ID NO: 20443 - RNA, 20 nt, Artificial Sequence
  targeting sequence with TTCN PAM
uucauucauuggaaucuuug

SEQ ID NO: 20444 - RNA, 20 nt, Artificial Sequence
  targeting sequence with TTCN PAM
gaccuucaucgucucaagcu

SEQ ID NO: 20445 - RNA, 20 nt, Artificial Sequence
  targeting sequence with TTCN PAM
ucgucucaagcugaaauaau

SEQ ID NO: 20446 - RNA, 20 nt, Artificial Sequence
  targeting sequence with TTCN PAM
gcuugagacgaugaaggucu

SEQ ID NO: 20447 - RNA, 20 nt, Artificial Sequence
  targeting sequence with TTCN PAM
auugaggcugugaacaagug

SEQ ID NO: 20448 - RNA, 20 nt, Artificial Sequence
  targeting sequence with TTCN PAM
cagccucaauagaagguggu

SEQ ID NO: 20449 - RNA, 20 nt, Artificial Sequence
  targeting sequence with TTCN PAM
uccucguaaagcaggaauag

SEQ ID NO: 20450 - RNA, 20 nt, Artificial Sequence
  targeting sequence with TTCN PAM
ugcuuuacgaggaggaagcu

SEQ ID NO: 20451 - RNA, 20 nt, Artificial Sequence
  targeting sequence with TTCN PAM
gcaagaaugaagaagagcua

SEQ ID NO: 20452 - RNA, 20 nt, Artificial Sequence
  targeting sequence with TTCN PAM
ugcagaaugaucucaguuua

SEQ ID NO: 20453 - RNA, 20 nt, Artificial Sequence
  targeting sequence with TTCN PAM
uucuugcagaaugaucucag

SEQ ID NO: 20454 - RNA, 20 nt, Artificial Sequence
  targeting sequence with TTCN PAM
ucauucuugcagaaugaucu

SEQ ID NO: 20455 - RNA, 20 nt, Artificial Sequence
  targeting sequence with TTCN PAM
ugcaguagcucuucuucauu

SEQ ID NO: 20456 - RNA, 20 nt, Artificial Sequence
  targeting sequence with TTCN PAM
ucuugcaguagcucuucuuc

SEQ ID NO: 20457 - RNA, 20 nt, Artificial Sequence
  targeting sequence with TTCN PAM
aguaguucuucuugcaguag

SEQ ID NO: 20458 - RNA, 20 nt, Artificial Sequence
  targeting sequence with TTCN PAM
uccaguaguucuucuugcag

SEQ ID NO: 20459 - RNA, 20 nt, Artificial Sequence
  targeting sequence with TTCN PAM
agcucccuuucuagccucau

SEQ ID NO: 20460 - RNA, 20 nt, Artificial Sequence
  targeting sequence with TTCN PAM
agccucaugcauuucaagga

SEQ ID NO: 20461 - RNA, 20 nt, Artificial Sequence
  targeting sequence with TTCN PAM
aggaaaucacuucucuucua

SEQ ID NO: 20462 - RNA, 20 nt, Artificial Sequence
  targeting sequence with TTCN PAM
uugaaaugcaugaggcuaga

SEQ ID NO: 20463 - RNA, 20 nt, Artificial Sequence
  targeting sequence with TTCN PAM
cuucuaacuauaagcagcca

SEQ ID NO: 20464 - RNA, 20 nt, Artificial Sequence
  targeting sequence with TTCN PAM
aacuauaagcagccagaaag

SEQ ID NO: 20465 - RNA, 20 nt, Artificial Sequence
  targeting sequence with TTCN PAM
ggcugcuuauaguuagaaga

SEQ ID NO: 20466 - RNA, 20 nt, Artificial Sequence
  targeting sequence with TTCN PAM
cccgaccucccucugugccu

SEQ ID NO: 20467 - RNA, 20 nt, Artificial Sequence
  targeting sequence with TTCN PAM
cccucauacaaugggcccca

SEQ ID NO: 20468 - RNA, 20 nt, Artificial Sequence
  targeting sequence with TTCN PAM
uuucccuucaggugcacuaa

SEQ ID NO: 20469 - RNA, 20 nt, Artificial Sequence
  targeting sequence with TTCN PAM
cuucaggugcacuaagauag

SEQ ID NO: 20470 - RNA, 20 nt, Artificial Sequence
  targeting sequence with TTCN PAM
ggugcacuaagauagggaag

SEQ ID NO: 20471 - RNA, 20 nt, Artificial Sequence
  targeting sequence with TTCN PAM
cuaucuuagugcaccugaag

SEQ ID NO: 20472 - RNA, 20 nt, Artificial Sequence
  targeting sequence with TTCN PAM
gcagcugcaggcauaucccc

SEQ ID NO: 20473 - RNA, 20 nt, Artificial Sequence
  targeting sequence with TTCN PAM
auacaucuuucugcagcugc

SEQ ID NO: 20474 - RNA, 20 nt, Artificial Sequence
  targeting sequence with TTCN PAM
cugucucuuuguuguguuua

SEQ ID NO: 20475 - RNA, 20 nt, Artificial Sequence
  targeting sequence with TTCN PAM
acugugaauccuuaaaaacu

SEQ ID NO: 20476 - RNA, 20 nt, Artificial Sequence
  targeting sequence with TTCN PAM
caguggaagaguuuaucaga

SEQ ID NO: 20477 - RNA, 20 nt, Artificial Sequence
  targeting sequence with TTCN PAM
cuuacagacuaagaguuuuu

SEQ ID NO: 20478 - RNA, 20 nt, Artificial Sequence
  targeting sequence with TTCN PAM
cuaaaauaaaccugucuuug

SEQ ID NO: 20479 - RNA, 20 nt, Artificial Sequence
  targeting sequence with TTCN PAM
uguuucuuuccucuuucuuu

SEQ ID NO: 20480 - RNA, 20 nt, Artificial Sequence
  targeting sequence with TTCN PAM
uuccucuuucuuuaauucuu

SEQ ID NO: 20481 - RNA, 20 nt, Artificial Sequence
  targeting sequence with TTCN PAM
ucuuucuuuaauucuuacac

SEQ ID NO: 20482 - RNA, 20 nt, Artificial Sequence
  targeting sequence with TTCN PAM
uuaauucuuacacaccccag

SEQ ID NO: 20483 - RNA, 20 nt, Artificial Sequence
  targeting sequence with TTCN PAM
uacacaccccagucuaccua

SEQ ID NO: 20484 - RNA, 20 nt, Artificial Sequence
  targeting sequence with TTCN PAM
cuggugagcaauagugggua

SEQ ID NO: 20485 - RNA, 20 nt, Artificial Sequence
  targeting sequence with TTCN PAM
uuuucccuggugagcaauag

SEQ ID NO: 20486 - RNA, 20 nt, Artificial Sequence
  targeting sequence with TTCN PAM
caguaaguaaacacaaagcc

SEQ ID NO: 20487 - RNA, 20 nt, Artificial Sequence
  targeting sequence with TTCN PAM
cagcagagauauuuuggguc

SEQ ID NO: 20488 - RNA, 20 nt, Artificial Sequence
  targeting sequence with TTCN PAM
augaccacagugugcuguga

SEQ ID NO: 20489 - RNA, 20 nt, Artificial Sequence
  targeting sequence with TTCN PAM
cucugauacucuuugugccu

SEQ ID NO: 20490 - RNA, 20 nt, Artificial Sequence
  targeting sequence with TTCN PAM
cugagcucugagagaggcag

SEQ ID NO: 20491 - RNA, 20 nt, Artificial Sequence
  targeting sequence with TTCN PAM
cugcagggcagcugguugag

SEQ ID NO: 20492 - RNA, 20 nt, Artificial Sequence
  targeting sequence with TTCN PAM
auguccagucucaaccagcu

SEQ ID NO: 20493 - RNA, 20 nt, Artificial Sequence
  targeting sequence with TTCN PAM
ucaguccuccaggagauuuu

SEQ ID NO: 20494 - RNA, 20 nt, Artificial Sequence
  targeting sequence with TTCN PAM
uaacaaugguaaagaucugg

SEQ ID NO: 20495 - RNA, 20 nt, Artificial Sequence
  targeting sequence with TTCN PAM
uuguccucccugagucacac

SEQ ID NO: 20496 - RNA, 20 nt, Artificial Sequence
  targeting sequence with TTCN PAM
ugccaaccugguagauggga

SEQ ID NO: 20497 - RNA, 20 nt, Artificial Sequence
  targeting sequence with TTCN PAM
caucuaccagguuggcagga

SEQ ID NO: 20498 - RNA, 20 nt, Artificial Sequence
  targeting sequence with TTCN PAM
uuuagaaaaacaaagcugug

SEQ ID NO: 20499 - RNA, 20 nt, Artificial Sequence
  targeting sequence with TTCN PAM
aaaugaaacaaaucuugcuc

SEQ ID NO: 20500 - RNA, 20 nt, Artificial Sequence
  targeting sequence with TTCN PAM
caaacauagccacagcuuug

SEQ ID NO: 20501 - RNA, 20 nt, Artificial Sequence
  targeting sequence with TTCN PAM
agcacccuucccaaacauag

SEQ ID NO: 20502 - RNA, 20 nt, Artificial Sequence
  targeting sequence with TTCN PAM
uuuuuguuuguuuguuuacu

SEQ ID NO: 20503 - RNA, 20 nt, Artificial Sequence
  targeting sequence with TTCN PAM
uguaguaaacaaacaaacaa

SEQ ID NO: 20504 - RNA, 20 nt, Artificial Sequence
  targeting sequence with TTCN PAM
uuauaucuuaguaccauucu

SEQ ID NO: 20505 - RNA, 20 nt, Artificial Sequence
  targeting sequence with TTCN PAM
cagccagagcuuuagcaagu

SEQ ID NO: 20506 - RNA, 20 nt, Artificial Sequence
  targeting sequence with TTCN PAM
aauuugccucugugccuugu

SEQ ID NO: 20507 - RNA, 20 nt, Artificial Sequence
  targeting sequence with TTCN PAM
aucugccaagcaauacauuu

SEQ ID NO: 20508 - RNA, 20 nt, Artificial Sequence
  targeting sequence with TTCN PAM
gcuaucagggguauuauggc

SEQ ID NO: 20509 - RNA, 20 nt, Artificial Sequence
  targeting sequence with TTCN PAM
aguaaacuguaaacaugugc

SEQ ID NO: 20510 - RNA, 20 nt, Artificial Sequence
  targeting sequence with TTCN PAM
gguucugaacaagaauuuua

SEQ ID NO: 20511 - RNA, 20 nt, Artificial Sequence
  targeting sequence with TTCN PAM
gaacaagaauuuuaucaaua

SEQ ID NO: 20512 - RNA, 20 nt, Artificial Sequence
  targeting sequence with TTCN PAM
gaaccagaauuagcacaugu

SEQ ID NO: 20513 - RNA, 20 nt, Artificial Sequence
  targeting sequence with TTCN PAM
uguucagaaccagaauuagc

SEQ ID NO: 20514 - RNA, 20 nt, Artificial Sequence
  targeting sequence with TTCN PAM
agagacauuuaugugugugu

SEQ ID NO: 20515 - RNA, 20 nt, Artificial Sequence
  targeting sequence with TTCN PAM
cagccucucaggugggcucu

SEQ ID NO: 20516 - RNA, 20 nt, Artificial Sequence
  targeting sequence with TTCN PAM
uagaggaggauacucagccc

SEQ ID NO: 20517 - RNA, 20 nt, Artificial Sequence
  targeting sequence with TTCN PAM
aagacaaaugagucccagcc

SEQ ID NO: 20518 - RNA, 20 nt, Artificial Sequence
  targeting sequence with TTCN PAM
cuugagugcccagcuaccac

SEQ ID NO: 20519 - RNA, 20 nt, Artificial Sequence
  targeting sequence with TTCN PAM
ggcccagagauuaacuaagg

SEQ ID NO: 20520 - RNA, 20 nt, Artificial Sequence
  targeting sequence with TTCN PAM
agaggcuuggccaaaccaca

SEQ ID NO: 20521 - RNA, 20 nt, Artificial Sequence
  targeting sequence with TTCN PAM
ccaguuuuggccgacugugg

SEQ ID NO: 20522 - RNA, 20 nt, Artificial Sequence
  targeting sequence with TTCN PAM
ucaguguguuccccaguuuu

SEQ ID NO: 20523 - RNA, 20 nt, Artificial Sequence
  targeting sequence with TTCN PAM
caagagagcugagguagauc

SEQ ID NO: 20524 - RNA, 20 nt, Artificial Sequence
  targeting sequence with TTCN PAM
ucagagggacuccgaccuga

SEQ ID NO: 20525 - RNA, 20 nt, Artificial Sequence
  targeting sequence with TTCN PAM
gagggacuccgaccugagga

SEQ ID NO: 20526 - RNA, 20 nt, Artificial Sequence
  targeting sequence with TTCN PAM
cucuccucaggucggagucc

SEQ ID NO: 20527 - RNA, 20 nt, Artificial Sequence
  targeting sequence with TTCN PAM
gacuagcaggcucccaucca

SEQ ID NO: 20528 - RNA, 20 nt, Artificial Sequence
  targeting sequence with TTCN PAM
ugguuuuaaauuauuaucag

SEQ ID NO: 20529 - RNA, 20 nt, Artificial Sequence
  targeting sequence with TTCN PAM
uuuaaguugagaucuugcuc

SEQ ID NO: 20530 - RNA, 20 nt, Artificial Sequence
  targeting sequence with TTCN PAM
cacuuuggccuuccaaagug

SEQ ID NO: 20531 - RNA, 20 nt, Artificial Sequence
  targeting sequence with TTCN PAM
aaaguguugggggauuacag

SEQ ID NO: 20532 - RNA, 20 nt, Artificial Sequence
  targeting sequence with TTCN PAM
aaauguauaaaaacguaauu

SEQ ID NO: 20533 - RNA, 20 nt, Artificial Sequence
  targeting sequence with TTCN PAM
ucuagacuaggguuagcaag

SEQ ID NO: 20534 - RNA, 20 nt, Artificial Sequence
  targeting sequence with TTCN PAM
auaaaaagucagauaaggcc

SEQ ID NO: 20535 - RNA, 20 nt, Artificial Sequence
  targeting sequence with TTCN PAM
ccauguuggccaggaugguc

SEQ ID NO: 20536 - RNA, 20 nt, Artificial Sequence
  targeting sequence with TTCN PAM
cuacuaaaaauacaaaaauu

SEQ ID NO: 20537 - RNA, 20 nt, Artificial Sequence
  targeting sequence with TTCN PAM
ugccucagacucccgaguag

SEQ ID NO: 20538 - RNA, 20 nt, Artificial Sequence
  targeting sequence with TTCN PAM
agcaauuuuccugccucaga

SEQ ID NO: 20539 - RNA, 20 nt, Artificial Sequence
  targeting sequence with TTCN PAM
ugcuacaauggcagaguuga

SEQ ID NO: 20540 - RNA, 20 nt, Artificial Sequence
  targeting sequence with TTCN PAM
aggaugaaugaguguggcug

SEQ ID NO: 20541 - RNA, 20 nt, Artificial Sequence
  targeting sequence with TTCN PAM
uccuugaauugucuauggcu

SEQ ID NO: 20542 - RNA, 20 nt, Artificial Sequence
  targeting sequence with TTCN PAM
aauaaaacucuauuuaaaaa

SEQ ID NO: 20543 - RNA, 20 nt, Artificial Sequence
  targeting sequence with TTCN PAM
uguuuuuuaaauagaguuuu

SEQ ID NO: 20544 - RNA, 20 nt, Artificial Sequence
  targeting sequence with TTCN PAM
augaugauggaaauguucca

SEQ ID NO: 20545 - RNA, 20 nt, Artificial Sequence
  targeting sequence with TTCN PAM
aucaucauggaaaguuguau

SEQ ID NO: 20546 - RNA, 20 nt, Artificial Sequence
  targeting sequence with TTCN PAM
acaucugugcaguccaguag

SEQ ID NO: 20547 - RNA, 20 nt, Artificial Sequence
  targeting sequence with TTCN PAM
aucacaccagccacauauuu

SEQ ID NO: 20548 - RNA, 20 nt, Artificial Sequence
  targeting sequence with TTCN PAM
cuggcuauuuauuaauuuaa

SEQ ID NO: 20549 - RNA, 20 nt, Artificial Sequence
  targeting sequence with TTCN PAM
aacgagcuccuggugaugcc

SEQ ID NO: 20550 - RNA, 20 nt, Artificial Sequence
  targeting sequence with TTCN PAM
gacccagcacaucugugggu

SEQ ID NO: 20551 - RNA, 20 nt, Artificial Sequence
  targeting sequence with TTCN PAM
acaggacacccauguaacuu

SEQ ID NO: 20552 - RNA, 20 nt, Artificial Sequence
  targeting sequence with TTCN PAM
cugaucuuaguuuugggguc

SEQ ID NO: 20553 - RNA, 20 nt, Artificial Sequence
  targeting sequence with TTCN PAM
ccaagguagcuggcugguua

SEQ ID NO: 20554 - RNA, 20 nt, Artificial Sequence
  targeting sequence with TTCN PAM
acucagguggggguuuucaa

SEQ ID NO: 20555 - RNA, 20 nt, Artificial Sequence
  targeting sequence with TTCN PAM
aggucagacuggugcggggc

SEQ ID NO: 20556 - RNA, 20 nt, Artificial Sequence
  targeting sequence with TTCN PAM
agccuuaauaaguaauaagg

SEQ ID NO: 20557 - RNA, 20 nt, Artificial Sequence
  targeting sequence with TTCN PAM
caguugaaccagaacccagc

SEQ ID NO: 20558 - RNA, 20 nt, Artificial Sequence
  targeting sequence with TTCN PAM
acugagaaguagacacaagg

SEQ ID NO: 20559 - RNA, 20 nt, Artificial Sequence
  targeting sequence with TTCN PAM
gguucaacugagaaguagac

SEQ ID NO: 20560 - RNA, 20 nt, Artificial Sequence
  targeting sequence with TTCN PAM
cuggaugggccuaagugggc

SEQ ID NO: 20561 - RNA, 20 nt, Artificial Sequence
  targeting sequence with TTCN PAM
ucgcggcuguaaaggcagua

SEQ ID NO: 20562 - RNA, 20 nt, Artificial Sequence
  targeting sequence with TTCN PAM
cugguucucacccuggccca

SEQ ID NO: 20563 - RNA, 20 nt, Artificial Sequence
  targeting sequence with TTCN PAM
cacccuggcccaccuuguga

SEQ ID NO: 20564 - RNA, 20 nt, Artificial Sequence
  targeting sequence with TTCN PAM
caaggugggccagggugaga

SEQ ID NO: 20565 - RNA, 20 nt, Artificial Sequence
  targeting sequence with TTCN PAM
ucuggaagaggugagagggu

SEQ ID NO: 20566 - RNA, 20 nt, Artificial Sequence
  targeting sequence with TTCN PAM
ggaagaggugagaggguagg

SEQ ID NO: 20567 - RNA, 20 nt, Artificial Sequence
  targeting sequence with TTCN PAM
agaagaaagcccccaggcuc

SEQ ID NO: 20568 - RNA, 20 nt, Artificial Sequence
  targeting sequence with TTCN PAM
aaggagacaggccaggcgga

SEQ ID NO: 20569 - RNA, 20 nt, Artificial Sequence
  targeting sequence with TTCN PAM
gggcaacuguguuuggccac

SEQ ID NO: 20570 - RNA, 20 nt, Artificial Sequence
  targeting sequence with TTCN PAM
cugagccuugguuuucucau

SEQ ID NO: 20571 - RNA, 20 nt, Artificial Sequence
  targeting sequence with TTCN PAM
caucugaaaaacacaaggcu

SEQ ID NO: 20572 - RNA, 20 nt, Artificial Sequence
  targeting sequence with TTCN PAM
gaugagaaaaccaaggcuca

SEQ ID NO: 20573 - RNA, 20 nt, Artificial Sequence
  targeting sequence with TTCN PAM
uauauugcccaagccuugug

SEQ ID NO: 20574 - RNA, 20 nt, Artificial Sequence
  targeting sequence with TTCN PAM
uucuuauccacaucucuccu

SEQ ID NO: 20575 - RNA, 20 nt, Artificial Sequence
  targeting sequence with TTCN PAM
uauccacaucucuccuguca

SEQ ID NO: 20576 - RNA, 20 nt, Artificial Sequence
  targeting sequence with TTCN PAM
cuggagccagguggagacuc

SEQ ID NO: 20577 - RNA, 20 nt, Artificial Sequence
  targeting sequence with TTCN PAM
cacgacuuggaguuacgguu

SEQ ID NO: 20578 - RNA, 20 nt, Artificial Sequence
  targeting sequence with TTCN PAM
gcagucugagcugagcgccu

SEQ ID NO: 20579 - RNA, 20 nt, Artificial Sequence
  targeting sequence with TTCN PAM
uuuauucaaucaauuuaauu

SEQ ID NO: 20580 - RNA, 20 nt, Artificial Sequence
  targeting sequence with TTCN PAM
aucaauuuaauuuucaaauu

SEQ ID NO: 20581 - RNA, 20 nt, Artificial Sequence
  targeting sequence with TTCN PAM
aauuauaccuuaaaauggua

SEQ ID NO: 20582 - RNA, 20 nt, Artificial Sequence
  targeting sequence with TTCN PAM
gcucacucacucuuuuaccu

SEQ ID NO: 20583 - RNA, 20 nt, Artificial Sequence
  targeting sequence with TTCN PAM
cauuagguuaucaaauggau

SEQ ID NO: 20584 - RNA, 20 nt, Artificial Sequence
  targeting sequence with TTCN PAM
accccaguauccauuugaua

SEQ ID NO: 20585 - RNA, 20 nt, Artificial Sequence
  targeting sequence with TTCN PAM
aucagccuugcuaaagcuag

SEQ ID NO: 20586 - RNA, 20 nt, Artificial Sequence
  targeting sequence with TTCN PAM
aaacuaucaauaauacaaag

SEQ ID NO: 20587 - RNA, 20 nt, Artificial Sequence
  targeting sequence with TTCN PAM
ucuucugauuauauuucauc

SEQ ID NO: 20588 - RNA, 20 nt, Artificial Sequence
  targeting sequence with TTCN PAM
gauuauauuucaucauugga

SEQ ID NO: 20589 - RNA, 20 nt, Artificial Sequence
  targeting sequence with TTCN PAM
ucauuggaaaagccguauuu

SEQ ID NO: 20590 - RNA, 20 nt, Artificial Sequence
  targeting sequence with TTCN PAM
aaugaugaaauauaaucaga

SEQ ID NO: 20591 - RNA, 20 nt, Artificial Sequence
  targeting sequence with TTCN PAM
aacacauucaguagcaaaga

SEQ ID NO: 20592 - RNA, 20 nt, Artificial Sequence
  targeting sequence with TTCN PAM
guagcaaagauccaccauug

SEQ ID NO: 20593 - RNA, 20 nt, Artificial Sequence
  targeting sequence with TTCN PAM
uaaugugugugccaauggug

SEQ ID NO: 20594 - RNA, 20 nt, Artificial Sequence
  targeting sequence with TTCN PAM
agcucaucuguuaugcauag

SEQ ID NO: 20595 - RNA, 20 nt, Artificial Sequence
  targeting sequence with TTCN PAM
ugauuuucccaaagccaguc

SEQ ID NO: 20596 - RNA, 20 nt, Artificial Sequence
  targeting sequence with TTCN PAM
caaagccagucaugauauuu

SEQ ID NO: 20597 - RNA, 20 nt, Artificial Sequence
  targeting sequence with TTCN PAM
gggugcaccuggaagaaaca

SEQ ID NO: 20598 - RNA, 20 nt, Artificial Sequence
  targeting sequence with TTCN PAM
aggugcacccugaagaccac

SEQ ID NO: 20599 - RNA, 20 nt, Artificial Sequence
  targeting sequence with TTCN PAM
uccaggugcacccugaagac

SEQ ID NO: 20600 - RNA, 20 nt, Artificial Sequence
  targeting sequence with TTCN PAM
gcccuguugaauaugcccag

SEQ ID NO: 20601 - RNA, 20 nt, Artificial Sequence
  targeting sequence with TTCN PAM
cuuaguggucucagacuacg

SEQ ID NO: 20602 - RNA, 20 nt, Artificial Sequence
  targeting sequence with TTCN PAM
ugcuuuccuguaguggugua

SEQ ID NO: 20603 - RNA, 20 nt, Artificial Sequence
  targeting sequence with TTCN PAM
uguagugguguacuuuugac

SEQ ID NO: 20604 - RNA, 20 nt, Artificial Sequence
  targeting sequence with TTCN PAM
uccugucaaaaguacaccac

SEQ ID NO: 20605 - RNA, 20 nt, Artificial Sequence
  targeting sequence with TTCN PAM
ugucauucccuauuugugug

SEQ ID NO: 20606 - RNA, 20 nt, Artificial Sequence
  targeting sequence with TTCN PAM
gcacauuuggucucugaggc

SEQ ID NO: 20607 - RNA, 20 nt, Artificial Sequence
  targeting sequence with TTCN PAM
acucauugacacaaaaaauu

SEQ ID NO: 20608 - RNA, 20 nt, Artificial Sequence
  targeting sequence with TTCN PAM
guaagagucguugccauauu

SEQ ID NO: 20609 - RNA, 20 nt, Artificial Sequence
  targeting sequence with TTCN PAM
ugggauugguaaauauggca

SEQ ID NO: 20610 - RNA, 20 nt, Artificial Sequence
  targeting sequence with TTCN PAM
acugcuuugucagguauuca

SEQ ID NO: 20611 - RNA, 20 nt, Artificial Sequence
  targeting sequence with TTCN PAM
ucugaagaauacaacauccc

SEQ ID NO: 20612 - RNA, 20 nt, Artificial Sequence
  targeting sequence with TTCN PAM
gaugaauaccugacaaagca

SEQ ID NO: 20613 - RNA, 20 nt, Artificial Sequence
  targeting sequence with TTCN PAM
ucagaugaauaccugacaaa

SEQ ID NO: 20614 - RNA, 20 nt, Artificial Sequence
  targeting sequence with TTCN PAM
aaagacacccucccaaaaug

SEQ ID NO: 20615 - RNA, 20 nt, Artificial Sequence
  targeting sequence with TTCN PAM
ccaaaccacagucucccacu

SEQ ID NO: 20616 - RNA, 20 nt, Artificial Sequence
  targeting sequence with TTCN PAM
uuuggguguauaggaaaaua

SEQ ID NO: 20617 - RNA, 20 nt, Artificial Sequence
  targeting sequence with TTCN PAM
uauacacccaaaggaaaaac

SEQ ID NO: 20618 - RNA, 20 nt, Artificial Sequence
  targeting sequence with TTCN PAM
cagguauuuuccuauacacc

SEQ ID NO: 20619 - RNA, 20 nt, Artificial Sequence
  targeting sequence with TTCN PAM
ggcaaaaaccauugucaagu

SEQ ID NO: 20620 - RNA, 20 nt, Artificial Sequence
  targeting sequence with TTCN PAM
uaaaccucuuggucucuacg

SEQ ID NO: 20621 - RNA, 20 nt, Artificial Sequence
  targeting sequence with TTCN PAM
gacacaucucuccagucugc

SEQ ID NO: 20622 - RNA, 20 nt, Artificial Sequence
  targeting sequence with TTCN PAM
ugcuaccucagcugaaggau

SEQ ID NO: 20623 - RNA, 20 nt, Artificial Sequence
  targeting sequence with TTCN PAM
gcugagguagcaagaaccgc

SEQ ID NO: 20624 - RNA, 20 nt, Artificial Sequence
  targeting sequence with TTCN PAM
ccagaaacuuccaaagcaca

SEQ ID NO: 20625 - RNA, 20 nt, Artificial Sequence
  targeting sequence with TTCN PAM
ggagaaguauccuucagcug

SEQ ID NO: 20626 - RNA, 20 nt, Artificial Sequence
  targeting sequence with TTCN PAM
aaagcacagguauugccauu

SEQ ID NO: 20627 - RNA, 20 nt, Artificial Sequence
  targeting sequence with TTCN PAM
caggcaaaauggcaauaccu

SEQ ID NO: 20628 - RNA, 20 nt, Artificial Sequence
  targeting sequence with TTCN PAM
guuacuuuuacuucccaggc

SEQ ID NO: 20629 - RNA, 20 nt, Artificial Sequence
  targeting sequence with TTCN PAM
uguucaaguaguuucucaua

SEQ ID NO: 20630 - RNA, 20 nt, Artificial Sequence
  targeting sequence with TTCN PAM
aguaguuucucauagaaauc

SEQ ID NO: 20631 - RNA, 20 nt, Artificial Sequence
  targeting sequence with TTCN PAM
gcauaauuuggacuauuagc

SEQ ID NO: 20632 - RNA, 20 nt, Artificial Sequence
  targeting sequence with TTCN PAM
acucucauuaucugcugauc

SEQ ID NO: 20633 - RNA, 20 nt, Artificial Sequence
  targeting sequence with TTCN PAM
cugaugaucaaaaagaauuu

SEQ ID NO: 20634 - RNA, 20 nt, Artificial Sequence
  targeting sequence with TTCN PAM
uuuugaucaucagugaaaau

SEQ ID NO: 20635 - RNA, 20 nt, Artificial Sequence
  targeting sequence with TTCN PAM
aaauucuuuuugaucaucag

SEQ ID NO: 20636 - RNA, 20 nt, Artificial Sequence
  targeting sequence with TTCN PAM
aaaaggucuguuggauguca

SEQ ID NO: 20637 - RNA, 20 nt, Artificial Sequence
  targeting sequence with TTCN PAM
caaucggaccucagguuugg

SEQ ID NO: 20638 - RNA, 20 nt, Artificial Sequence
  targeting sequence with TTCN PAM
caucgcuacuauauuucuca

SEQ ID NO: 20639 - RNA, 20 nt, Artificial Sequence
  targeting sequence with TTCN PAM
auggaucaugaaaaaguguu

SEQ ID NO: 20640 - RNA, 20 nt, Artificial Sequence
  targeting sequence with TTCN PAM
ugauccauggaagcuucuca

SEQ ID NO: 20641 - RNA, 20 nt, Artificial Sequence
  targeting sequence with TTCN PAM
ugaacgagauuaaaagguga

SEQ ID NO: 20642 - RNA, 20 nt, Artificial Sequence
  targeting sequence with TTCN PAM
agaaacacuuuuucaugauc

SEQ ID NO: 20643 - RNA, 20 nt, Artificial Sequence
  targeting sequence with TTCN PAM
uaaaggcuuuacgucguggg

SEQ ID NO: 20644 - RNA, 20 nt, Artificial Sequence
  targeting sequence with TTCN PAM
gaugcacuauguuuguuuag

SEQ ID NO: 20645 - RNA, 20 nt, Artificial Sequence
  targeting sequence with TTCN PAM
auucugaugcacuauguuug

SEQ ID NO: 20646 - RNA, 20 nt, Artificial Sequence
  targeting sequence with TTCN PAM
auuuuggguuuucaauucug

SEQ ID NO: 20647 - RNA, 20 nt, Artificial Sequence
  targeting sequence with TTCN PAM
aauuccauuuuggguuuuca

SEQ ID NO: 20648 - RNA, 20 nt, Artificial Sequence
  targeting sequence with TTCN PAM
gauugggaaagggauaccuu

SEQ ID NO: 20649 - RNA, 20 nt, Artificial Sequence
  targeting sequence with TTCN PAM
caaucagaacagcaaauucu

SEQ ID NO: 20650 - RNA, 20 nt, Artificial Sequence
  targeting sequence with TTCN PAM
uuguuauauuugcuggaaaa

SEQ ID NO: 20651 - RNA, 20 nt, Artificial Sequence
  targeting sequence with TTCN PAM
agcaaauauaacaaagaagg

SEQ ID NO: 20652 - RNA, 20 nt, Artificial Sequence
  targeting sequence with TTCN PAM
uucuuucuaucuguguucgu

SEQ ID NO: 20653 - RNA, 20 nt, Artificial Sequence
  targeting sequence with TTCN PAM
uucuaucuguguucguggga

SEQ ID NO: 20654 - RNA, 20 nt, Artificial Sequence
  targeting sequence with TTCN PAM
aucuguguucgugggauggu

SEQ ID NO: 20655 - RNA, 20 nt, Artificial Sequence
  targeting sequence with TTCN PAM
ugggaugguaucuucugaaa

SEQ ID NO: 20656 - RNA, 20 nt, Artificial Sequence
  targeting sequence with TTCN PAM
gaaaaggaaaaguaaacacu

SEQ ID NO: 20657 - RNA, 20 nt, Artificial Sequence
  targeting sequence with TTCN PAM
gaagauaccaucccacgaac

SEQ ID NO: 20658 - RNA, 20 nt, Artificial Sequence
  targeting sequence with TTCN PAM
uuuucagaagauaccauccc

SEQ ID NO: 20659 - RNA, 20 nt, Artificial Sequence
  targeting sequence with TTCN PAM
ugggucauuaguuagauuaa

SEQ ID NO: 20660 - RNA, 20 nt, Artificial Sequence
  targeting sequence with TTCN PAM
cugugccucaauguccuuau

SEQ ID NO: 20661 - RNA, 20 nt, Artificial Sequence
  targeting sequence with TTCN PAM
caauagucuaaaaaauacuu

SEQ ID NO: 20662 - RNA, 20 nt, Artificial Sequence
  targeting sequence with TTCN PAM
uauuaacuucuaaaugaaaa

SEQ ID NO: 20663 - RNA, 20 nt, Artificial Sequence
  targeting sequence with TTCN PAM
ccuuuuuuauaaaauuggga

SEQ ID NO: 20664 - RNA, 20 nt, Artificial Sequence
  targeting sequence with TTCN PAM
guauuguuauuuauauaugu

SEQ ID NO: 20665 - RNA, 20 nt, Artificial Sequence
  targeting sequence with TTCN PAM
uaacuucuguauuguuauuu

SEQ ID NO: 20666 - RNA, 20 nt, Artificial Sequence
  targeting sequence with TTCN PAM
uucuuaacuucuguauuguu

SEQ ID NO: 20667 - RNA, 20 nt, Artificial Sequence
  targeting sequence with TTCN PAM
uuccuucuuuacuuuucugu

SEQ ID NO: 20668 - RNA, 20 nt, Artificial Sequence
  targeting sequence with TTCN PAM
uucuuuacuuuucuguauuu

SEQ ID NO: 20669 - RNA, 20 nt, Artificial Sequence
  targeting sequence with TTCN PAM
uuacuuuucuguauuuucca

SEQ ID NO: 20670 - RNA, 20 nt, Artificial Sequence
  targeting sequence with TTCN PAM
guauuuuccaaaauuucugc

SEQ ID NO: 20671 - RNA, 20 nt, Artificial Sequence
  targeting sequence with TTCN PAM
aaaauuucugcagugaacac

SEQ ID NO: 20672 - RNA, 20 nt, Artificial Sequence
  targeting sequence with TTCN PAM
gcagugaacacuuacuuuua

SEQ ID NO: 20673 - RNA, 20 nt, Artificial Sequence
  targeting sequence with TTCN PAM
cugcagaaauuuuggaaaau

SEQ ID NO: 20674 - RNA, 20 nt, Artificial Sequence
  targeting sequence with TTCN PAM
aauugcgaggguaugguuaa

SEQ ID NO: 20675 - RNA, 20 nt, Artificial Sequence
  targeting sequence with TTCN PAM
cuucucauuuuacaauauuu

SEQ ID NO: 20676 - RNA, 20 nt, Artificial Sequence
  targeting sequence with TTCN PAM
cauuuuacaauauuuuugau

SEQ ID NO: 20677 - RNA, 20 nt, Artificial Sequence
  targeting sequence with TTCN PAM
caucaaaaauauuguaaaau

SEQ ID NO: 20678 - RNA, 20 nt, Artificial Sequence
  targeting sequence with TTCN PAM
ucuguaaaauagagguaacc

SEQ ID NO: 20679 - RNA, 20 nt, Artificial Sequence
  targeting sequence with TTCN PAM
ucaucuguaaaauagaggua

SEQ ID NO: 20680 - RNA, 20 nt, Artificial Sequence
  targeting sequence with TTCN PAM
cuuucuucaucuguaaaaua

SEQ ID NO: 20681 - RNA, 20 nt, Artificial Sequence
  targeting sequence with TTCN PAM
aaaugaagcaaucaucccaa

SEQ ID NO: 20682 - RNA, 20 nt, Artificial Sequence
  targeting sequence with TTCN PAM
uuuagaagcuucacuuucuu

SEQ ID NO: 20683 - RNA, 20 nt, Artificial Sequence
  targeting sequence with TTCN PAM
ucucauguugagaacuagac

SEQ ID NO: 20684 - RNA, 20 nt, Artificial Sequence
  targeting sequence with TTCN PAM
caacaugagaugaaguacuc

SEQ ID NO: 20685 - RNA, 20 nt, Artificial Sequence
  targeting sequence with TTCN PAM
caaauuucuccaggcuguuu

SEQ ID NO: 20686 - RNA, 20 nt, Artificial Sequence
  targeting sequence with TTCN PAM
ccaggcuguuuccccacagg

SEQ ID NO: 20687 - RNA, 20 nt, Artificial Sequence
  targeting sequence with TTCN PAM
ccacaggaguuuaaguaaaa

SEQ ID NO: 20688 - RNA, 20 nt, Artificial Sequence
  targeting sequence with TTCN PAM
uuaaaggaguuauucauuau

SEQ ID NO: 20689 - RNA, 20 nt, Artificial Sequence
  targeting sequence with TTCN PAM
uuauaccauaauggcauaau

SEQ ID NO: 20690 - RNA, 20 nt, Artificial Sequence
  targeting sequence with TTCN PAM
uuaugccauuaugguauaau

SEQ ID NO: 20691 - RNA, 20 nt, Artificial Sequence
  targeting sequence with TTCN PAM
cugagguauuauaaagacaa

SEQ ID NO: 20692 - RNA, 20 nt, Artificial Sequence
  targeting sequence with TTCN PAM
gaauucuguauuaagagcau

SEQ ID NO: 20693 - RNA, 20 nt, Artificial Sequence
  targeting sequence with TTCN PAM
gaacuuagcaguuuugucuu

SEQ ID NO: 20694 - RNA, 20 nt, Artificial Sequence
  targeting sequence with TTCN PAM
guauuaagagcauauuacaa

SEQ ID NO: 20695 - RNA, 20 nt, Artificial Sequence
  targeting sequence with TTCN PAM
ucuauuauuuguaauaugcu

SEQ ID NO: 20696 - RNA, 20 nt, Artificial Sequence
  targeting sequence with TTCN PAM
aaaguauaaucacauaguuc

SEQ ID NO: 20697 - RNA, 20 nt, Artificial Sequence
  targeting sequence with TTCN PAM
cuaaaaugcuuuagagcucu

SEQ ID NO: 20698 - RNA, 20 nt, Artificial Sequence
  targeting sequence with TTCN PAM
auuuuaauguaaugcuucuc

SEQ ID NO: 20699 - RNA, 20 nt, Artificial Sequence
  targeting sequence with TTCN PAM
agcacuauuaaacauuaugu

SEQ ID NO: 20700 - RNA, 20 nt, Artificial Sequence
  targeting sequence with TTCN PAM
agguauccagugcuuucaag

SEQ ID NO: 20701 - RNA, 20 nt, Artificial Sequence
  targeting sequence with TTCN PAM
caccagugaagucuuuccug

SEQ ID NO: 20702 - RNA, 20 nt, Artificial Sequence
  targeting sequence with TTCN PAM
cuggugagaaaauauuucaa

SEQ ID NO: 20703 - RNA, 20 nt, Artificial Sequence
  targeting sequence with TTCN PAM
ugguuggugagcaguuguug

SEQ ID NO: 20704 - RNA, 20 nt, Artificial Sequence
  targeting sequence with TTCN PAM
gagccacguuuuaaaauguc

SEQ ID NO: 20705 - RNA, 20 nt, Artificial Sequence
  targeting sequence with TTCN PAM
uuccuuuccacaacuucuac

SEQ ID NO: 20706 - RNA, 20 nt, Artificial Sequence
  targeting sequence with TTCN PAM
uuuccacaacuucuacuuuu

SEQ ID NO: 20707 - RNA, 20 nt, Artificial Sequence
  targeting sequence with TTCN PAM
acaacuucuacuuuuguucc

SEQ ID NO: 20708 - RNA, 20 nt, Artificial Sequence
  targeting sequence with TTCN PAM
acuuuuguuccgauuucuuc

SEQ ID NO: 20709 - RNA, 20 nt, Artificial Sequence
  targeting sequence with TTCN PAM
gauuucuucagauucuaaaa

SEQ ID NO: 20710 - RNA, 20 nt, Artificial Sequence
  targeting sequence with TTCN PAM
ucagauucuaaaaagguauc

SEQ ID NO: 20711 - RNA, 20 nt, Artificial Sequence
  targeting sequence with TTCN PAM
gauucuaaaaagguauccuc

SEQ ID NO: 20712 - RNA, 20 nt, Artificial Sequence
  targeting sequence with TTCN PAM
aaaaagguauccucauacuu

SEQ ID NO: 20713 - RNA, 20 nt, Artificial Sequence
  targeting sequence with TTCN PAM
cguuguguucugagucuuug

SEQ ID NO: 20714 - RNA, 20 nt, Artificial Sequence
  targeting sequence with TTCN PAM
gagucuuuggcugaacaaaa

SEQ ID NO: 20715 - RNA, 20 nt, Artificial Sequence
  targeting sequence with TTCN PAM
gccaaagacucagaacacaa

SEQ ID NO: 20716 - RNA, 20 nt, Artificial Sequence
  targeting sequence with TTCN PAM
ggcaucauaaacaaauuuug

SEQ ID NO: 20717 - RNA, 20 nt, Artificial Sequence
  targeting sequence with TTCN PAM
gaacaaaaauuugauccuga

SEQ ID NO: 20718 - RNA, 20 nt, Artificial Sequence
  targeting sequence with TTCN PAM
gaacaaaaaacuucuggcau

SEQ ID NO: 20719 - RNA, 20 nt, Artificial Sequence
  targeting sequence with TTCN PAM
ggaucaaauuuuuguucuga

SEQ ID NO: 20720 - RNA, 20 nt, Artificial Sequence
  targeting sequence with TTCN PAM
aagugauagcaaaagagaau

SEQ ID NO: 20721 - RNA, 20 nt, Artificial Sequence
  targeting sequence with TTCN PAM
gguuuuguucaaagugauag

SEQ ID NO: 20722 - RNA, 20 nt, Artificial Sequence
  targeting sequence with TTCN PAM
uacauccuuuuuuaguuuuc

SEQ ID NO: 20723 - RNA, 20 nt, Artificial Sequence
  targeting sequence with TTCN PAM
uaauugggauuccuuucaaa

SEQ ID NO: 20724 - RNA, 20 nt, Artificial Sequence
  targeting sequence with TTCN PAM
uuucaaaauagucaccuuuc

SEQ ID NO: 20725 - RNA, 20 nt, Artificial Sequence
  targeting sequence with TTCN PAM
aaauagucaccuuuccuuug

SEQ ID NO: 20726 - RNA, 20 nt, Artificial Sequence
  targeting sequence with TTCN PAM
uuugggcuuucuaaccuuuc

SEQ ID NO: 20727 - RNA, 20 nt, Artificial Sequence
  targeting sequence with TTCN PAM
aaccuuucugaaguuaacau

SEQ ID NO: 20728 - RNA, 20 nt, Artificial Sequence
  targeting sequence with TTCN PAM
gaaguuaacaucaucaacac

SEQ ID NO: 20729 - RNA, 20 nt, Artificial Sequence
  targeting sequence with TTCN PAM
gaaagguuagaaagcccaaa

SEQ ID NO: 20730 - RNA, 20 nt, Artificial Sequence
  targeting sequence with TTCN PAM
uucaaaagcaaaugagugga

SEQ ID NO: 20731 - RNA, 20 nt, Artificial Sequence
  targeting sequence with TTCN PAM
aaagcaaaugaguggaagua

SEQ ID NO: 20732 - RNA, 20 nt, Artificial Sequence
  targeting sequence with TTCN PAM
acucauuugcuuuugaaaga

SEQ ID NO: 20733 - RNA, 20 nt, Artificial Sequence
  targeting sequence with TTCN PAM
gguccugagguuccaguuug

SEQ ID NO: 20734 - RNA, 20 nt, Artificial Sequence
  targeting sequence with TTCN PAM
aguuugaauuguuacuuugg

SEQ ID NO: 20735 - RNA, 20 nt, Artificial Sequence
  targeting sequence with TTCN PAM
aacuggaaccucaggacccg

SEQ ID NO: 20736 - RNA, 20 nt, Artificial Sequence
  targeting sequence with TTCN PAM
aaaagggguaucaagucaag

SEQ ID NO: 20737 - RNA, 20 nt, Artificial Sequence
  targeting sequence with TTCN PAM
ggcuuaagagaagucucucc

SEQ ID NO: 20738 - RNA, 20 nt, Artificial Sequence
  targeting sequence with TTCN PAM
cuuaagccagaagauuuuga

SEQ ID NO: 20739 - RNA, 20 nt, Artificial Sequence
  targeting sequence with TTCN PAM
caaaaauggagagacuucuc

SEQ ID NO: 20740 - RNA, 20 nt, Artificial Sequence
  targeting sequence with TTCN PAM
cuugcuaauuaucuucacaa

SEQ ID NO: 20741 - RNA, 20 nt, Artificial Sequence
  targeting sequence with TTCN PAM
gauccaaaaguucacuugcu

SEQ ID NO: 20742 - RNA, 20 nt, Artificial Sequence
  targeting sequence with TTCN PAM
guccuugugggcuagaaaau

SEQ ID NO: 20743 - RNA, 20 nt, Artificial Sequence
  targeting sequence with TTCN PAM
agcccacaaggacugaaguu

SEQ ID NO: 20744 - RNA, 20 nt, Artificial Sequence
  targeting sequence with TTCN PAM
uuuaauaucauuuucuagcc

SEQ ID NO: 20745 - RNA, 20 nt, Artificial Sequence
  targeting sequence with TTCN PAM
auuuacuagcaguaaguuuc

SEQ ID NO: 20746 - RNA, 20 nt, Artificial Sequence
  targeting sequence with TTCN PAM
uuuaaaagucccuucuauuu

SEQ ID NO: 20747 - RNA, 20 nt, Artificial Sequence
  targeting sequence with TTCN PAM
gauuucuaauuaauuuccaa

SEQ ID NO: 20748 - RNA, 20 nt, Artificial Sequence
  targeting sequence with TTCN PAM
aauuaauuuccaaauguugc

SEQ ID NO: 20749 - RNA, 20 nt, Artificial Sequence
  targeting sequence with TTCN PAM
aaauguugccauagguaucu

SEQ ID NO: 20750 - RNA, 20 nt, Artificial Sequence
  targeting sequence with TTCN PAM
uuuuuaaaugacagauaccu

SEQ ID NO: 20751 - RNA, 20 nt, Artificial Sequence
  targeting sequence with TTCN PAM
ugcugucuucccaaauaacc

SEQ ID NO: 20752 - RNA, 20 nt, Artificial Sequence
  targeting sequence with TTCN PAM
caaauaaccuuugcuucaca

SEQ ID NO: 20753 - RNA, 20 nt, Artificial Sequence
  targeting sequence with TTCN PAM
caacucuuucccauccacau

SEQ ID NO: 20754 - RNA, 20 nt, Artificial Sequence
  targeting sequence with TTCN PAM
cauccacaugggacagacuu

SEQ ID NO: 20755 - RNA, 20 nt, Artificial Sequence
  targeting sequence with TTCN PAM
guuccugcaguagcaccaaa

SEQ ID NO: 20756 - RNA, 20 nt, Artificial Sequence
  targeting sequence with TTCN PAM
ugcaguagcaccaaacugag

SEQ ID NO: 20757 - RNA, 20 nt, Artificial Sequence
  targeting sequence with TTCN PAM
gcucaguuuggugcuacugc

SEQ ID NO: 20758 - RNA, 20 nt, Artificial Sequence
  targeting sequence with TTCN PAM
uguagcaagggauuacauuc

SEQ ID NO: 20759 - RNA, 20 nt, Artificial Sequence
  targeting sequence with TTCN PAM
cugcuucuuuuuaucaucau

SEQ ID NO: 20760 - RNA, 20 nt, Artificial Sequence
  targeting sequence with TTCN PAM
uuuuaucaucauuuguuccu

SEQ ID NO: 20761 - RNA, 20 nt, Artificial Sequence
  targeting sequence with TTCN PAM
ucaucuucucccacucuuuc

SEQ ID NO: 20762 - RNA, 20 nt, Artificial Sequence
  targeting sequence with TTCN PAM
cccacucuuuccaauuccau

SEQ ID NO: 20763 - RNA, 20 nt, Artificial Sequence
  targeting sequence with TTCN PAM
aauuccauagcaacaucuuc

SEQ ID NO: 20764 - RNA, 20 nt, Artificial Sequence
  targeting sequence with TTCN PAM
auagcaacaucuucuuugcu

SEQ ID NO: 20765 - RNA, 20 nt, Artificial Sequence
  targeting sequence with TTCN PAM
uugcuggaaaaacaaagucu

SEQ ID NO: 20766 - RNA, 20 nt, Artificial Sequence
  targeting sequence with TTCN PAM
agcaaagaagauguugcuau

SEQ ID NO: 20767 - RNA, 20 nt, Artificial Sequence
  targeting sequence with TTCN PAM
ugucuuccaaaagcuuccca

SEQ ID NO: 20768 - RNA, 20 nt, Artificial Sequence
  targeting sequence with TTCN PAM
aaaagcuucccauauccucu

SEQ ID NO: 20769 - RNA, 20 nt, Artificial Sequence
  targeting sequence with TTCN PAM
cauauccucuagcacagguu

SEQ ID NO: 20770 - RNA, 20 nt, Artificial Sequence
  targeting sequence with TTCN PAM
aacaccuuuuaaccugugcu

SEQ ID NO: 20771 - RNA, 20 nt, Artificial Sequence
  targeting sequence with TTCN PAM
agcuugacuuuuuuguugug

SEQ ID NO: 20772 - RNA, 20 nt, Artificial Sequence
  targeting sequence with TTCN PAM
gauuaaucacugaguagggc

SEQ ID NO: 20773 - RNA, 20 nt, Artificial Sequence
  targeting sequence with TTCN PAM
gggggcacuuaccauaaauu

SEQ ID NO: 20774 - RNA, 20 nt, Artificial Sequence
  targeting sequence with TTCN PAM
caaauuuaugguaagugccc

SEQ ID NO: 20775 - RNA, 20 nt, Artificial Sequence
  targeting sequence with TTCN PAM
uauucucaaauuuaugguaa

SEQ ID NO: 20776 - RNA, 20 nt, Artificial Sequence
  targeting sequence with TTCN PAM
ggugcuuaagagcuuagcua

SEQ ID NO: 20777 - RNA, 20 nt, Artificial Sequence
  targeting sequence with TTCN PAM
cugcaaauaaaugagguaaa

SEQ ID NO: 20778 - RNA, 20 nt, Artificial Sequence
  targeting sequence with TTCN PAM
gggagagaguguguaucacu

SEQ ID NO: 20779 - RNA, 20 nt, Artificial Sequence
  targeting sequence with TTCN PAM
ucagauguaauccuccagaa

SEQ ID NO: 20780 - RNA, 20 nt, Artificial Sequence
  targeting sequence with TTCN PAM
ggaggauuacaucugaugaa

SEQ ID NO: 20781 - RNA, 20 nt, Artificial Sequence
  targeting sequence with TTCN PAM
guaucaaauuauuuaccuuc

SEQ ID NO: 20782 - RNA, 20 nt, Artificial Sequence
  targeting sequence with TTCN PAM
aaaauucuguaucaaauuau

SEQ ID NO: 20783 - RNA, 20 nt, Artificial Sequence
  targeting sequence with TTCN PAM
ucauucuugauccucauggu

SEQ ID NO: 20784 - RNA, 20 nt, Artificial Sequence
  targeting sequence with TTCN PAM
uucuugauccucaugguaac

SEQ ID NO: 20785 - RNA, 20 nt, Artificial Sequence
  targeting sequence with TTCN PAM
ugauccucaugguaaccuug

SEQ ID NO: 20786 - RNA, 20 nt, Artificial Sequence
  targeting sequence with TTCN PAM
gcaaguaauuuaaccuguca

SEQ ID NO: 20787 - RNA, 20 nt, Artificial Sequence
  targeting sequence with TTCN PAM
cgugucuguucugcaaguaa

SEQ ID NO: 20788 - RNA, 20 nt, Artificial Sequence
  targeting sequence with TTCN PAM
cccccauacuguuauugaaa

SEQ ID NO: 20789 - RNA, 20 nt, Artificial Sequence
  targeting sequence with TTCN PAM
auaacaguaugggggagaag

SEQ ID NO: 20790 - RNA, 20 nt, Artificial Sequence
  targeting sequence with TTCN PAM
uguaaugcuagcacuuuggg

SEQ ID NO: 20791 - RNA, 20 nt, Artificial Sequence
  targeting sequence with TTCN PAM
uccucccaaagugcuagcau

SEQ ID NO: 20792 - RNA, 20 nt, Artificial Sequence
  targeting sequence with TTCN PAM
cacuuccuccucccaaagug

SEQ ID NO: 20793 - RNA, 20 nt, Artificial Sequence
  targeting sequence with TTCN PAM
uuuuuugcaaagacgaggau

SEQ ID NO: 20794 - RNA, 20 nt, Artificial Sequence
  targeting sequence with TTCN PAM
gggagcuaugauugugccac

SEQ ID NO: 20795 - RNA, 20 nt, Artificial Sequence
  targeting sequence with TTCN PAM
uuaaaguuccaaugugucuu

SEQ ID NO: 20796 - RNA, 20 nt, Artificial Sequence
  targeting sequence with TTCN PAM
aaugugucuucuaugaugaa

SEQ ID NO: 20797 - RNA, 20 nt, Artificial Sequence
  targeting sequence with TTCN PAM
augaugaaaacauacuuuua

SEQ ID NO: 20798 - RNA, 20 nt, Artificial Sequence
  targeting sequence with TTCN PAM
ucauagaagacacauuggaa

SEQ ID NO: 20799 - RNA, 20 nt, Artificial Sequence
  targeting sequence with TTCN PAM
guaaaguguauccuaaucac

SEQ ID NO: 20800 - RNA, 20 nt, Artificial Sequence
  targeting sequence with TTCN PAM
uuucuacaaauagggaaacu

SEQ ID NO: 20801 - RNA, 20 nt, Artificial Sequence
  targeting sequence with TTCN PAM
acaaauagggaaacugcaag

SEQ ID NO: 20802 - RNA, 20 nt, Artificial Sequence
  targeting sequence with TTCN PAM
cuauuuguagaaaagaacuu

SEQ ID NO: 20803 - RNA, 20 nt, Artificial Sequence
  targeting sequence with TTCN PAM
ugcaguuucccuauuuguag

SEQ ID NO: 20804 - RNA, 20 nt, Artificial Sequence
  targeting sequence with TTCN PAM
aguucuugcaguuucccuau

SEQ ID NO: 20805 - RNA, 20 nt, Artificial Sequence
  targeting sequence with TTCN PAM
aauucuaguucuugcaguuu

SEQ ID NO: 20806 - RNA, 20 nt, Artificial Sequence
  targeting sequence with TTCN PAM
gauguaauuugggguaaaau

SEQ ID NO: 20807 - RNA, 20 nt, Artificial Sequence
  targeting sequence with TTCN PAM
uaagauccauccagcuccuc

SEQ ID NO: 20808 - RNA, 20 nt, Artificial Sequence
  targeting sequence with TTCN PAM
guauuuuuaucucuaaaauu

SEQ ID NO: 20809 - RNA, 20 nt, Artificial Sequence
  targeting sequence with TTCN PAM
accaggcuucaguauuuuua

SEQ ID NO: 20810 - RNA, 20 nt, Artificial Sequence
  targeting sequence with TTCN PAM
agcucuaccagcuguaaguu

SEQ ID NO: 20811 - RNA, 20 nt, Artificial Sequence
  targeting sequence with TTCN PAM
uuuuacagagucuuuuaccg

SEQ ID NO: 20812 - RNA, 20 nt, Artificial Sequence
  targeting sequence with TTCN PAM
aaguaguucuuaguauuaaa

SEQ ID NO: 20813 - RNA, 20 nt, Artificial Sequence
  targeting sequence with TTCN PAM
uaguauuaaauuuugaaaaa

SEQ ID NO: 20814 - RNA, 20 nt, Artificial Sequence
  targeting sequence with TTCN PAM
aaauuuaauacuaagaacua

SEQ ID NO: 20815 - RNA, 20 nt, Artificial Sequence
  targeting sequence with TTCN PAM
uaggauccuccaaccccaag

SEQ ID NO: 20816 - RNA, 20 nt, Artificial Sequence
  targeting sequence with TTCN PAM
caaaaccucccggcuccccc

SEQ ID NO: 20817 - RNA, 20 nt, Artificial Sequence
  targeting sequence with TTCN PAM
ucaucuaagaugacuaggga

SEQ ID NO: 20818 - RNA, 20 nt, Artificial Sequence
  targeting sequence with TTCN PAM
ugugcgaucagcccuggggu

SEQ ID NO: 20819 - RNA, 20 nt, Artificial Sequence
  targeting sequence with TTCN PAM
agguuucugccgacccucug

SEQ ID NO: 20820 - RNA, 20 nt, Artificial Sequence
  targeting sequence with TTCN PAM
gccgacccucugucaaaggu

SEQ ID NO: 20821 - RNA, 20 nt, Artificial Sequence
  targeting sequence with TTCN PAM
aaccuuugacagagggucgg

SEQ ID NO: 20822 - RNA, 20 nt, Artificial Sequence
  targeting sequence with TTCN PAM
ccaccuguaaaaugguaucg

SEQ ID NO: 20823 - RNA, 20 nt, Artificial Sequence
  targeting sequence with TTCN PAM
gcgggucugggacuaggcgc

SEQ ID NO: 20824 - RNA, 20 nt, Artificial Sequence
  targeting sequence with TTCN PAM
caucuuacuccgccccacac

SEQ ID NO: 20825 - RNA, 20 nt, Artificial Sequence
  targeting sequence with TTCN PAM
gcucacggcaccgggcugca

SEQ ID NO: 20826 - RNA, 20 nt, Artificial Sequence
  targeting sequence with TTCN PAM
gaccucgguugcagcccggu

SEQ ID NO: 20827 - RNA, 20 nt, Artificial Sequence
  targeting sequence with TTCN PAM
caacauucagaccucgguug

SEQ ID NO: 20828 - RNA, 20 nt, Artificial Sequence
  targeting sequence with TTCN PAM
ggccgcccccucggcuacag

SEQ ID NO: 20829 - RNA, 20 nt, Artificial Sequence
  targeting sequence with TTCN PAM
acgcuccaccaaucaaaucc

SEQ ID NO: 20830 - RNA, 20 nt, Artificial Sequence
  targeting sequence with TTCN PAM
cgaggaagacgcaccgcccc

SEQ ID NO: 20831 - RNA, 20 nt, Artificial Sequence
  targeting sequence with TTCN PAM
ucgagaauggauuugauugg

SEQ ID NO: 20832 - RNA, 20 nt, Artificial Sequence
  targeting sequence with TTCN PAM
ggcuuucccuuucggacaug

SEQ ID NO: 20833 - RNA, 20 nt, Artificial Sequence
  targeting sequence with TTCN PAM
cuuucggacaugcgcgcucg

SEQ ID NO: 20834 - RNA, 20 nt, Artificial Sequence
  targeting sequence with TTCN PAM
gacaugcgcgcucggagcaa

SEQ ID NO: 20835 - RNA, 20 nt, Artificial Sequence
  targeting sequence with TTCN PAM
cuuacggcucgggcuccucc

SEQ ID NO: 20836 - RNA, 20 nt, Artificial Sequence
  targeting sequence with TTCN PAM
cgaagagcaggaggucgagu

SEQ ID NO: 20837 - RNA, 20 nt, Artificial Sequence
  targeting sequence with TTCN PAM
cgaaccgccccgcuccucac

SEQ ID NO: 20838 - RNA, 20 nt, Artificial Sequence
  targeting sequence with TTCN PAM
gugcccucggcccaggcagc

SEQ ID NO: 20839 - RNA, 20 nt, Artificial Sequence
  targeting sequence with TTCN PAM
ccaaccgccaaggggcggga

SEQ ID NO: 20840 - RNA, 20 nt, Artificial Sequence
  targeting sequence with TTCN PAM
cucacggucuggcccugucg

SEQ ID NO: 20841 - RNA, 20 nt, Artificial Sequence
  targeting sequence with TTCN PAM
ucucacacccacgagacagc

SEQ ID NO: 20842 - RNA, 20 nt, Artificial Sequence
  targeting sequence with TTCN PAM
ugcugucucgugggugugag

SEQ ID NO: 20843 - RNA, 20 nt, Artificial Sequence
  targeting sequence with TTCN PAM
caguucuugccacauccaca

SEQ ID NO: 20844 - RNA, 20 nt, Artificial Sequence
  targeting sequence with TTCN PAM
ugccacauccacauaguacc

SEQ ID NO: 20845 - RNA, 20 nt, Artificial Sequence
  targeting sequence with TTCN PAM
ugacguuuuucucuaaauug

SEQ ID NO: 20846 - RNA, 20 nt, Artificial Sequence
  targeting sequence with TTCN PAM
cuaaauugucucauuuauuu

SEQ ID NO: 20847 - RNA, 20 nt, Artificial Sequence
  targeting sequence with TTCN PAM
cauuuuacaaggaaacuuua

SEQ ID NO: 20848 - RNA, 20 nt, Artificial Sequence
  targeting sequence with TTCN PAM
uuguaaaaugugaaaucaua

SEQ ID NO: 20849 - RNA, 20 nt, Artificial Sequence
  targeting sequence with TTCN PAM
uaaauggaguaauaaaguuu

SEQ ID NO: 20850 - RNA, 20 nt, Artificial Sequence
  targeting sequence with TTCN PAM
cccuacuuuaaguuuuacuu

SEQ ID NO: 20851 - RNA, 20 nt, Artificial Sequence
  targeting sequence with TTCN PAM
guuuuguuucucccuacuuu

SEQ ID NO: 20852 - RNA, 20 nt, Artificial Sequence
  targeting sequence with TTCN PAM
cuaaaacuggagaugggcag

SEQ ID NO: 20853 - RNA, 20 nt, Artificial Sequence
  targeting sequence with TTCN PAM
gaucauaccugcccaucucc

SEQ ID NO: 20854 - RNA, 20 nt, Artificial Sequence
  targeting sequence with TTCN PAM
caauuaggagagcuuguguu

SEQ ID NO: 20855 - RNA, 20 nt, Artificial Sequence
  targeting sequence with TTCN PAM
gacuucccaauuaggagagc

SEQ ID NO: 20856 - RNA, 20 nt, Artificial Sequence
  targeting sequence with TTCN PAM
uuuucagacuucccaauuag

SEQ ID NO: 20857 - RNA, 20 nt, Artificial Sequence
  targeting sequence with TTCN PAM
guucuuuuucagacuuccca

SEQ ID NO: 20858 - RNA, 20 nt, Artificial Sequence
  targeting sequence with TTCN PAM
ccuucaguucuuuuucagac

SEQ ID NO: 20859 - RNA, 20 nt, Artificial Sequence
  targeting sequence with TTCN PAM
guuauuuaauguccuauucc

SEQ ID NO: 20860 - RNA, 20 nt, Artificial Sequence
  targeting sequence with TTCN PAM
auuguuaucgccuaaaucua

SEQ ID NO: 20861 - RNA, 20 nt, Artificial Sequence
  targeting sequence with TTCN PAM
uacuuaugggauaggucuug

SEQ ID NO: 20862 - RNA, 20 nt, Artificial Sequence
  targeting sequence with TTCN PAM
aagucaggccaagaccuauc

SEQ ID NO: 20863 - RNA, 20 nt, Artificial Sequence
  targeting sequence with TTCN PAM
gcauuguugugaagccucug

SEQ ID NO: 20864 - RNA, 20 nt, Artificial Sequence
  targeting sequence with TTCN PAM
caacaaugcugaaugauuuu

SEQ ID NO: 20865 - RNA, 20 nt, Artificial Sequence
  targeting sequence with TTCN PAM
ggccacuggagcagguuacu

SEQ ID NO: 20866 - RNA, 20 nt, Artificial Sequence
  targeting sequence with TTCN PAM
gucccuucugagaucuuucu

SEQ ID NO: 20867 - RNA, 20 nt, Artificial Sequence
  targeting sequence with TTCN PAM
gagaucuuucucuguguaaa

SEQ ID NO: 20868 - RNA, 20 nt, Artificial Sequence
  targeting sequence with TTCN PAM
cuguguaaagcaugccgucu

SEQ ID NO: 20869 - RNA, 20 nt, Artificial Sequence
  targeting sequence with TTCN PAM
gugugagaugaggagagacg

SEQ ID NO: 20870 - RNA, 20 nt, Artificial Sequence
  targeting sequence with TTCN PAM
ggauuuccgugugagaugag

SEQ ID NO: 20871 - RNA, 20 nt, Artificial Sequence
  targeting sequence with TTCN PAM
aggcucacguuggagacggg

SEQ ID NO: 20872 - RNA, 20 nt, Artificial Sequence
  targeting sequence with TTCN PAM
gcacuagugguagcugacac

SEQ ID NO: 20873 - RNA, 20 nt, Artificial Sequence
  targeting sequence with TTCN PAM
uauccuuuaucucguugugu

SEQ ID NO: 20874 - RNA, 20 nt, Artificial Sequence
  targeting sequence with TTCN PAM
ccacucucuaagguagguac

SEQ ID NO: 20875 - RNA, 20 nt, Artificial Sequence
  targeting sequence with TTCN PAM
ucuauuuuauguaugaggaa

SEQ ID NO: 20876 - RNA, 20 nt, Artificial Sequence
  targeting sequence with TTCN PAM
ucauacauaaaauagaggaa

SEQ ID NO: 20877 - RNA, 20 nt, Artificial Sequence
  targeting sequence with TTCN PAM
guuuccucauacauaaaaua

SEQ ID NO: 20878 - RNA, 20 nt, Artificial Sequence
  targeting sequence with TTCN PAM
accccucacugugugacgcu

SEQ ID NO: 20879 - RNA, 20 nt, Artificial Sequence
  targeting sequence with TTCN PAM
agcucaggucuuccucacuc

SEQ ID NO: 20880 - RNA, 20 nt, Artificial Sequence
  targeting sequence with TTCN PAM
ucacuccaacgucaacgcuc

SEQ ID NO: 20881 - RNA, 20 nt, Artificial Sequence
  targeting sequence with TTCN PAM
uuauguuacagacguggcaa

SEQ ID NO: 20882 - RNA, 20 nt, Artificial Sequence
  targeting sequence with TTCN PAM
acacuaggaauuguauguuu

SEQ ID NO: 20883 - RNA, 20 nt, Artificial Sequence
  targeting sequence with TTCN PAM
uaguguugaagaugcaaaua

SEQ ID NO: 20884 - RNA, 20 nt, Artificial Sequence
  targeting sequence with TTCN PAM
cuaggaauagucuuguauuc

SEQ ID NO: 20885 - RNA, 20 nt, Artificial Sequence
  targeting sequence with TTCN PAM
uagggaaaacauacaauucc

SEQ ID NO: 20886 - RNA, 20 nt, Artificial Sequence
  targeting sequence with TTCN PAM
guaccccauuuuucuugaaa

SEQ ID NO: 20887 - RNA, 20 nt, Artificial Sequence
  targeting sequence with TTCN PAM
ugaaacacagccguaucagu

SEQ ID NO: 20888 - RNA, 20 nt, Artificial Sequence
  targeting sequence with TTCN PAM
agaaaaaugggguacagaau

SEQ ID NO: 20889 - RNA, 20 nt, Artificial Sequence
  targeting sequence with TTCN PAM
cugauacggcuguguuucaa

SEQ ID NO: 20890 - RNA, 20 nt, Artificial Sequence
  targeting sequence with TTCN PAM
uuuguacuuuuaauagagau

SEQ ID NO: 20891 - RNA, 20 nt, Artificial Sequence
  targeting sequence with TTCN PAM
guugccagcuaucaucagcu

SEQ ID NO: 20892 - RNA, 20 nt, Artificial Sequence
  targeting sequence with TTCN PAM
augucagaguaauagagugu

SEQ ID NO: 20893 - RNA, 20 nt, Artificial Sequence
  targeting sequence with TTCN PAM
ugcauggugguaauuggcag

SEQ ID NO: 20894 - RNA, 20 nt, Artificial Sequence
  targeting sequence with TTCN PAM
uguuuuuaccagaagcuagg

SEQ ID NO: 20895 - RNA, 20 nt, Artificial Sequence
  targeting sequence with TTCN PAM
gguaaaaacaggaagagcug

SEQ ID NO: 20896 - RNA, 20 nt, Artificial Sequence
  targeting sequence with TTCN PAM
uagcuucugguaaaaacagg

SEQ ID NO: 20897 - RNA, 20 nt, Artificial Sequence
  targeting sequence with TTCN PAM
cauaaaaacccagauuccua

SEQ ID NO: 20898 - RNA, 20 nt, Artificial Sequence
  targeting sequence with TTCN PAM
gaguggaugcuaacauuuaa

SEQ ID NO: 20899 - RNA, 20 nt, Artificial Sequence
  targeting sequence with TTCN PAM
gccagcaaauguuuuauuug

SEQ ID NO: 20900 - RNA, 20 nt, Artificial Sequence
  targeting sequence with TTCN PAM
accccuggcacagaauuuug

SEQ ID NO: 20901 - RNA, 20 nt, Artificial Sequence
  targeting sequence with TTCN PAM
gugccagggguugaaaacag

SEQ ID NO: 20902 - RNA, 20 nt, Artificial Sequence
  targeting sequence with TTCN PAM
uuucucucuugugguacuuc

SEQ ID NO: 20903 - RNA, 20 nt, Artificial Sequence
  targeting sequence with TTCN PAM
cucuugugguacuuccagag

SEQ ID NO: 20904 - RNA, 20 nt, Artificial Sequence
  targeting sequence with TTCN PAM
agagucuguugagcauaaga

SEQ ID NO: 20905 - RNA, 20 nt, Artificial Sequence
  targeting sequence with TTCN PAM
gaagucuaauaaacccguua

SEQ ID NO: 20906 - RNA, 20 nt, Artificial Sequence
  targeting sequence with TTCN PAM
gaauuaaacagauuuaaaaa

SEQ ID NO: 20907 - RNA, 20 nt, Artificial Sequence
  targeting sequence with TTCN PAM
aaauuauucuagagacaggu

SEQ ID NO: 20908 - RNA, 20 nt, Artificial Sequence
  targeting sequence with TTCN PAM
agagacaggucagugguugu

SEQ ID NO: 20909 - RNA, 20 nt, Artificial Sequence
  targeting sequence with TTCN PAM
uuuuauauauaucuaguauu

SEQ ID NO: 20910 - RNA, 20 nt, Artificial Sequence
  targeting sequence with TTCN PAM
uacgugaaugaaugaugaau

SEQ ID NO: 20911 - RNA, 20 nt, Artificial Sequence
  targeting sequence with TTCN PAM
cguaugaauacaucuaccca

SEQ ID NO: 20912 - RNA, 20 nt, Artificial Sequence
  targeting sequence with TTCN PAM
uucacguaugaauacaucua

SEQ ID NO: 20913 - RNA, 20 nt, Artificial Sequence
  targeting sequence with TTCN PAM
ucauucauucacguaugaau

SEQ ID NO: 20914 - RNA, 20 nt, Artificial Sequence
  targeting sequence with TTCN PAM
gguuuuuggcccauuacaga

SEQ ID NO: 20915 - RNA, 20 nt, Artificial Sequence
  targeting sequence with TTCN PAM
auagaccaucaauccugaug

SEQ ID NO: 20916 - RNA, 20 nt, Artificial Sequence
  targeting sequence with TTCN PAM
gggcuaucagcugguauauc

SEQ ID NO: 20917 - RNA, 20 nt, Artificial Sequence
  targeting sequence with TTCN PAM
uucugggcuaucagcuggua

SEQ ID NO: 20918 - RNA, 20 nt, Artificial Sequence
  targeting sequence with TTCN PAM
acugucuuuuuuuuuuuugu

SEQ ID NO: 20919 - RNA, 20 nt, Artificial Sequence
  targeting sequence with TTCN PAM
auuuuaaccuucacauagca

SEQ ID NO: 20920 - RNA, 20 nt, Artificial Sequence
  targeting sequence with TTCN PAM
cauagcagcaggaacucugu

SEQ ID NO: 20921 - RNA, 20 nt, Artificial Sequence
  targeting sequence with TTCN PAM
ugcugcuaugugaagguuaa

SEQ ID NO: 20922 - RNA, 20 nt, Artificial Sequence
  targeting sequence with TTCN PAM
cauaaaccuagagugauucc

SEQ ID NO: 20923 - RNA, 20 nt, Artificial Sequence
  targeting sequence with TTCN PAM
caauuacuuuccaugucaag

SEQ ID NO: 20924 - RNA, 20 nt, Artificial Sequence
  targeting sequence with TTCN PAM
augucaagucgugcauuuug

SEQ ID NO: 20925 - RNA, 20 nt, Artificial Sequence
  targeting sequence with TTCN PAM
gcucaaccuaaaaguauaaa

SEQ ID NO: 20926 - RNA, 20 nt, Artificial Sequence
  targeting sequence with TTCN PAM
acccgaagauccuucccaaa

SEQ ID NO: 20927 - RNA, 20 nt, Artificial Sequence
  targeting sequence with TTCN PAM
gguagaaaaauagaguuuuc

SEQ ID NO: 20928 - RNA, 20 nt, Artificial Sequence
  targeting sequence with TTCN PAM
caaaugcucccuuauucuau

SEQ ID NO: 20929 - RNA, 20 nt, Artificial Sequence
  targeting sequence with TTCN PAM
augaacucccuaguuuucuc

SEQ ID NO: 20930 - RNA, 20 nt, Artificial Sequence
  targeting sequence with TTCN PAM
uagaauaagggagcauuugg

SEQ ID NO: 20931 - RNA, 20 nt, Artificial Sequence
  targeting sequence with TTCN PAM
ccuuuaaaugcacagcucca

SEQ ID NO: 20932 - RNA, 20 nt, Artificial Sequence
  targeting sequence with TTCN PAM
ucucaaccaggaugucuuau

SEQ ID NO: 20933 - RNA, 20 nt, Artificial Sequence
  targeting sequence with TTCN PAM
aaucaggcuagcaucugcug

SEQ ID NO: 20934 - RNA, 20 nt, Artificial Sequence
  targeting sequence with TTCN PAM
aaccucacauguuguagaga

SEQ ID NO: 20935 - RNA, 20 nt, Artificial Sequence
  targeting sequence with TTCN PAM
ucucauuuaaagaugaagaa

SEQ ID NO: 20936 - RNA, 20 nt, Artificial Sequence
  targeting sequence with TTCN PAM
ucuuuaaaugagaugaaaau

SEQ ID NO: 20937 - RNA, 20 nt, Artificial Sequence
  targeting sequence with TTCN PAM
ucaucuuuaaaugagaugaa

SEQ ID NO: 20938 - RNA, 20 nt, Artificial Sequence
  targeting sequence with TTCN PAM
ucuguaucucugcaauggaa

SEQ ID NO: 20939 - RNA, 20 nt, Artificial Sequence
  targeting sequence with TTCN PAM
aauucugaguuucuggugau

SEQ ID NO: 20940 - RNA, 20 nt, Artificial Sequence
  targeting sequence with TTCN PAM
gaguuucuggugauuucaua

SEQ ID NO: 20941 - RNA, 20 nt, Artificial Sequence
  targeting sequence with TTCN PAM
ggugauuucauaauuauauu

SEQ ID NO: 20942 - RNA, 20 nt, Artificial Sequence
  targeting sequence with TTCN PAM
uaauuauauuuauuacaugu

SEQ ID NO: 20943 - RNA, 20 nt, Artificial Sequence
  targeting sequence with TTCN PAM
uaaaauauaucauauauguc

SEQ ID NO: 20944 - RNA, 20 nt, Artificial Sequence
  targeting sequence with TTCN PAM
agauauucagagaaaaugaa

SEQ ID NO: 20945 - RNA, 20 nt, Artificial Sequence
  targeting sequence with TTCN PAM
gagaaaaugaauuuuuauau

SEQ ID NO: 20946 - RNA, 20 nt, Artificial Sequence
  targeting sequence with TTCN PAM
cugaauaucuugaaauuugc

SEQ ID NO: 20947 - RNA, 20 nt, Artificial Sequence
  targeting sequence with TTCN PAM
uuuucucugaauaucuugaa

SEQ ID NO: 20948 - RNA, 20 nt, Artificial Sequence
  targeting sequence with TTCN PAM
ucuuagauauaaaaauucau

SEQ ID NO: 20949 - RNA, 20 nt, Artificial Sequence
  targeting sequence with TTCN PAM
uccucuuagauauaaaaauu

SEQ ID NO: 20950 - RNA, 20 nt, Artificial Sequence
  targeting sequence with TTCN PAM
ggcuuggcucaaaugagaca

SEQ ID NO: 20951 - RNA, 20 nt, Artificial Sequence
  targeting sequence with TTCN PAM
gaaaugauuuugugauaauu

SEQ ID NO: 20952 - RNA, 20 nt, Artificial Sequence
  targeting sequence with TTCN PAM
gaaugucucauuugagccaa

SEQ ID NO: 20953 - RNA, 20 nt, Artificial Sequence
  targeting sequence with TTCN PAM
acccaaaaugacccuuauga

SEQ ID NO: 20954 - RNA, 20 nt, Artificial Sequence
  targeting sequence with TTCN PAM
uaagggucauuuuggguuga

SEQ ID NO: 20955 - RNA, 20 nt, Artificial Sequence
  targeting sequence with TTCN PAM
ucauaagggucauuuugggu

SEQ ID NO: 20956 - RNA, 20 nt, Artificial Sequence
  targeting sequence with TTCN PAM
ugugugaccucuucuucaua

SEQ ID NO: 20957 - RNA, 20 nt, Artificial Sequence
  targeting sequence with TTCN PAM
gccuuguacacauaugagcu

SEQ ID NO: 20958 - RNA, 20 nt, Artificial Sequence
  targeting sequence with TTCN PAM
uuucugccuuguacacauau

SEQ ID NO: 20959 - RNA, 20 nt, Artificial Sequence
  targeting sequence with TTCN PAM
caccuacaaaacaaggauag

SEQ ID NO: 20960 - RNA, 20 nt, Artificial Sequence
  targeting sequence with TTCN PAM
uucucaccuacaaaacaagg

SEQ ID NO: 20961 - RNA, 20 nt, Artificial Sequence
  targeting sequence with TTCN PAM
ggccccacguccccccuacu

SEQ ID NO: 20962 - RNA, 20 nt, Artificial Sequence
  targeting sequence with TTCN PAM
gccaugcugcuucucaaaau

SEQ ID NO: 20963 - RNA, 20 nt, Artificial Sequence
  targeting sequence with TTCN PAM
caaaaugugaaaugugccaa

SEQ ID NO: 20964 - RNA, 20 nt, Artificial Sequence
  targeting sequence with TTCN PAM
cauuuugagaagcagcaugg

SEQ ID NO: 20965 - RNA, 20 nt, Artificial Sequence
  targeting sequence with TTCN PAM
ucugagccuuggcacauuuc

SEQ ID NO: 20966 - RNA, 20 nt, Artificial Sequence
  targeting sequence with TTCN PAM
uccucugagccuuggcacau

SEQ ID NO: 20967 - RNA, 20 nt, Artificial Sequence
  targeting sequence with TTCN PAM
uacgcuuucuuccucugagc

SEQ ID NO: 20968 - RNA, 20 nt, Artificial Sequence
  targeting sequence with TTCN PAM
uuguuucuuacgcuuucuuc

SEQ ID NO: 20969 - RNA, 20 nt, Artificial Sequence
  targeting sequence with TTCN PAM
ucaccauuaugugguaacag

SEQ ID NO: 20970 - RNA, 20 nt, Artificial Sequence
  targeting sequence with TTCN PAM
gcuuccucaccauuaugugg

SEQ ID NO: 20971 - RNA, 20 nt, Artificial Sequence
  targeting sequence with TTCN PAM
guuugcccagcuggaaagag

SEQ ID NO: 20972 - RNA, 20 nt, Artificial Sequence
  targeting sequence with TTCN PAM
agcugggcaaacugaagccc

SEQ ID NO: 20973 - RNA, 20 nt, Artificial Sequence
  targeting sequence with TTCN PAM
agcuucuuuaucagccagcu

SEQ ID NO: 20974 - RNA, 20 nt, Artificial Sequence
  targeting sequence with TTCN PAM
uuaucagccagcucugugac

SEQ ID NO: 20975 - RNA, 20 nt, Artificial Sequence
  targeting sequence with TTCN PAM
ucauugguaaaaucggggca

SEQ ID NO: 20976 - RNA, 20 nt, Artificial Sequence
  targeting sequence with TTCN PAM
uaaggaucaaauaagauaau

SEQ ID NO: 20977 - RNA, 20 nt, Artificial Sequence
  targeting sequence with TTCN PAM
agccauucuccugccucagc

SEQ ID NO: 20978 - RNA, 20 nt, Artificial Sequence
  targeting sequence with TTCN PAM
ccugccucagccucccgagu

SEQ ID NO: 20979 - RNA, 20 nt, Artificial Sequence
  targeting sequence with TTCN PAM
uaaauauugaauaacuguga

SEQ ID NO: 20980 - RNA, 20 nt, Artificial Sequence
  targeting sequence with TTCN PAM
auauuuaagaauuguuaaag

SEQ ID NO: 20981 - RNA, 20 nt, Artificial Sequence
  targeting sequence with TTCN PAM
caguuauucaauauuuaaga

SEQ ID NO: 20982 - RNA, 20 nt, Artificial Sequence
  targeting sequence with TTCN PAM
uuuaauaaaaacucuucaca

SEQ ID NO: 20983 - RNA, 20 nt, Artificial Sequence
  targeting sequence with TTCN PAM
gaauucuucauguaaugccu

SEQ ID NO: 20984 - RNA, 20 nt, Artificial Sequence
  targeting sequence with TTCN PAM
gaaagcuuuuaauauggcuc

SEQ ID NO: 20985 - RNA, 20 nt, Artificial Sequence
  targeting sequence with TTCN PAM
ucauguaaugccuuaaguag

SEQ ID NO: 20986 - RNA, 20 nt, Artificial Sequence
  targeting sequence with TTCN PAM
uguaaugccuuaaguaggua

SEQ ID NO: 20987 - RNA, 20 nt, Artificial Sequence
  targeting sequence with TTCN PAM
guagcacuuuauuuucaggc

SEQ ID NO: 20988 - RNA, 20 nt, Artificial Sequence
  targeting sequence with TTCN PAM
ggcaaguuauuuaacuucuc

SEQ ID NO: 20989 - RNA, 20 nt, Artificial Sequence
  targeting sequence with TTCN PAM
cuguaccauaguuuucucau

SEQ ID NO: 20990 - RNA, 20 nt, Artificial Sequence
  targeting sequence with TTCN PAM
caucugugaaacagguauac

SEQ ID NO: 20991 - RNA, 20 nt, Artificial Sequence
  targeting sequence with TTCN PAM
cagaugagaaaacuauggua

SEQ ID NO: 20992 - RNA, 20 nt, Artificial Sequence
  targeting sequence with TTCN PAM
agggagcagaaggcagcaua

SEQ ID NO: 20993 - RNA, 20 nt, Artificial Sequence
  targeting sequence with TTCN PAM
gcucccuugaauuacugcca

SEQ ID NO: 20994 - RNA, 20 nt, Artificial Sequence
  targeting sequence with TTCN PAM
agacagcaccugcugagcuc

SEQ ID NO: 20995 - RNA, 20 nt, Artificial Sequence
  targeting sequence with TTCN PAM
aaguacugucauugagagug

SEQ ID NO: 20996 - RNA, 20 nt, Artificial Sequence
  targeting sequence with TTCN PAM
aacucuuauuccagacagca

SEQ ID NO: 20997 - RNA, 20 nt, Artificial Sequence
  targeting sequence with TTCN PAM
aaguuacugacaaaagcuug

SEQ ID NO: 20998 - RNA, 20 nt, Artificial Sequence
  targeting sequence with TTCN PAM
gaggccccccaaccaucuga

SEQ ID NO: 20999 - RNA, 20 nt, Artificial Sequence
  targeting sequence with TTCN PAM
gaugguuggggggccucuga

SEQ ID NO: 21000 - RNA, 20 nt, Artificial Sequence
  targeting sequence with TTCN PAM
uucucaaccagggcucuuuu

SEQ ID NO: 21001 - RNA, 20 nt, Artificial Sequence
  targeting sequence with TTCN PAM
caaccagggcucuuuuaaaa

SEQ ID NO: 21002 - RNA, 20 nt, Artificial Sequence
  targeting sequence with TTCN PAM
ggccaugaugggaaaugggg

SEQ ID NO: 21003 - RNA, 20 nt, Artificial Sequence
  targeting sequence with TTCN PAM
caucauggccugaaacaguc

SEQ ID NO: 21004 - RNA, 20 nt, Artificial Sequence
  targeting sequence with TTCN PAM
uaucauacuuaaagucugug

SEQ ID NO: 21005 - RNA, 20 nt, Artificial Sequence
  targeting sequence with TTCN PAM
ucugcaaacaguaacuuggg

SEQ ID NO: 21006 - RNA, 20 nt, Artificial Sequence
  targeting sequence with TTCN PAM
uuucuguugaaccuagguuu

SEQ ID NO: 21007 - RNA, 20 nt, Artificial Sequence
  targeting sequence with TTCN PAM
guugaaccuagguuuuuugu

SEQ ID NO: 21008 - RNA, 20 nt, Artificial Sequence
  targeting sequence with TTCN PAM
acagaaaggaaugccugggu

SEQ ID NO: 21009 - RNA, 20 nt, Artificial Sequence
  targeting sequence with TTCN PAM
gagacagagucucacucugu

SEQ ID NO: 21010 - RNA, 20 nt, Artificial Sequence
  targeting sequence with TTCN PAM
ggguucacgccauucuccug

SEQ ID NO: 21011 - RNA, 20 nt, Artificial Sequence
  targeting sequence with TTCN PAM
cgccauucuccugccucauc

SEQ ID NO: 21012 - RNA, 20 nt, Artificial Sequence
  targeting sequence with TTCN PAM
ccugccucauccucccgugu

SEQ ID NO: 21013 - RNA, 20 nt, Artificial Sequence
  targeting sequence with TTCN PAM
ccguguuagccaggaugguc

SEQ ID NO: 21014 - RNA, 20 nt, Artificial Sequence
  targeting sequence with TTCN PAM
gacaauugguugagcuuauc

SEQ ID NO: 21015 - RNA, 20 nt, Artificial Sequence
  targeting sequence with TTCN PAM
agcuuauagguugauuuaaa

SEQ ID NO: 21016 - RNA, 20 nt, Artificial Sequence
  targeting sequence with TTCN PAM
aguuguuccaucuuucugga

SEQ ID NO: 21017 - RNA, 20 nt, Artificial Sequence
  targeting sequence with TTCN PAM
aucuuucuggaccaaaccaa

SEQ ID NO: 21018 - RNA, 20 nt, Artificial Sequence
  targeting sequence with TTCN PAM
ggaccaaaccaaugcauuuc

SEQ ID NO: 21019 - RNA, 20 nt, Artificial Sequence
  targeting sequence with TTCN PAM
uaaauguauuugauugaagu

SEQ ID NO: 21020 - RNA, 20 nt, Artificial Sequence
  targeting sequence with TTCN PAM
aucaaauacauuuaagaaau

SEQ ID NO: 21021 - RNA, 20 nt, Artificial Sequence
  targeting sequence with TTCN PAM
cuaaaaugugucaaaccgag

SEQ ID NO: 21022 - RNA, 20 nt, Artificial Sequence
  targeting sequence with TTCN PAM
caggaccaccugagggcugu

SEQ ID NO: 21023 - RNA, 20 nt, Artificial Sequence
  targeting sequence with TTCN PAM
gagccaaauaugagugacca

SEQ ID NO: 21024 - RNA, 20 nt, Artificial Sequence
  targeting sequence with TTCN PAM
gauauuuuacagaguuugau

SEQ ID NO: 21025 - RNA, 20 nt, Artificial Sequence
  targeting sequence with TTCN PAM
gucaaauuaaauuauuuuga

SEQ ID NO: 21026 - RNA, 20 nt, Artificial Sequence
  targeting sequence with TTCN PAM
ugccaacacaaguaaucaaa

SEQ ID NO: 21027 - RNA, 20 nt, Artificial Sequence
  targeting sequence with TTCN PAM
gagccuaauaugagugacca

SEQ ID NO: 21028 - RNA, 20 nt, Artificial Sequence
  targeting sequence with TTCN PAM
guggaccuccugagggcugu

SEQ ID NO: 21029 - RNA, 20 nt, Artificial Sequence
  targeting sequence with TTCN PAM
uaaauguaucugauugaugu

SEQ ID NO: 21030 - RNA, 20 nt, Artificial Sequence
  targeting sequence with TTCN PAM
ggaucaaaccaauguauuuc

SEQ ID NO: 21031 - RNA, 20 nt, Artificial Sequence
  targeting sequence with TTCN PAM
aggcuauagguaaauuuaaa

SEQ ID NO: 21032 - RNA, 20 nt, Artificial Sequence
  targeting sequence with TTCN PAM
ggcugacaauuggcugaguu

SEQ ID NO: 21033 - RNA, 20 nt, Artificial Sequence
  targeting sequence with TTCN PAM
guugaucccaggucuuuaaa

SEQ ID NO: 21034 - RNA, 20 nt, Artificial Sequence
  targeting sequence with TTCN PAM
uuucuguugaucccaggucu

SEQ ID NO: 21035 - RNA, 20 nt, Artificial Sequence
  targeting sequence with TTCN PAM
uauuugcagaggaagccuuc

SEQ ID NO: 21036 - RNA, 20 nt, Artificial Sequence
  targeting sequence with TTCN PAM
ucugcaaauaagaacauggg

SEQ ID NO: 21037 - RNA, 20 nt, Artificial Sequence
  targeting sequence with TTCN PAM
gguacuaggcuucagaaaga

SEQ ID NO: 21038 - RNA, 20 nt, Artificial Sequence
  targeting sequence with TTCN PAM
gaaagaauagguuguaaaau

SEQ ID NO: 21039 - RNA, 20 nt, Artificial Sequence
  targeting sequence with TTCN PAM
gaagccuaguacccgaaggc

SEQ ID NO: 21040 - RNA, 20 nt, Artificial Sequence
  targeting sequence with TTCN PAM
uucugaagccuaguacccga

SEQ ID NO: 21041 - RNA, 20 nt, Artificial Sequence
  targeting sequence with TTCN PAM
ucucacccugcaaaacagag

SEQ ID NO: 21042 - RNA, 20 nt, Artificial Sequence
  targeting sequence with TTCN PAM
cacccugcaaaacagagucu

SEQ ID NO: 21043 - RNA, 20 nt, Artificial Sequence
  targeting sequence with TTCN PAM
agcaauucuccugccucagc

SEQ ID NO: 21044 - RNA, 20 nt, Artificial Sequence
  targeting sequence with TTCN PAM
ccugccucagccucccuagu

SEQ ID NO: 21045 - RNA, 20 nt, Artificial Sequence
  targeting sequence with TTCN PAM
ccauguuggucaggcuggcc

SEQ ID NO: 21046 - RNA, 20 nt, Artificial Sequence
  targeting sequence with TTCN PAM
cgucauggccugaaacaguc

SEQ ID NO: 21047 - RNA, 20 nt, Artificial Sequence
  targeting sequence with TTCN PAM
ggccaugacgggaagugggc

SEQ ID NO: 21048 - RNA, 20 nt, Artificial Sequence
  targeting sequence with TTCN PAM
uccucaaccagggcucuuuu

SEQ ID NO: 21049 - RNA, 20 nt, Artificial Sequence
  targeting sequence with TTCN PAM
gacgguugggggggcuuaca

SEQ ID NO: 21050 - RNA, 20 nt, Artificial Sequence
  targeting sequence with TTCN PAM
cacuuucaugucuuugcuug

SEQ ID NO: 21051 - RNA, 20 nt, Artificial Sequence
  targeting sequence with TTCN PAM
ugucuuugcuuguuuuauuu

SEQ ID NO: 21052 - RNA, 20 nt, Artificial Sequence
  targeting sequence with TTCN PAM
uugccugaaauguccuuuac

SEQ ID NO: 21053 - RNA, 20 nt, Artificial Sequence
  targeting sequence with TTCN PAM
ggcaaagaaaauaaaacaag

SEQ ID NO: 21054 - RNA, 20 nt, Artificial Sequence
  targeting sequence with TTCN PAM
aaagcccuaccuuuuucaaa

SEQ ID NO: 21055 - RNA, 20 nt, Artificial Sequence
  targeting sequence with TTCN PAM
aauaucuucuucauuaaucu

SEQ ID NO: 21056 - RNA, 20 nt, Artificial Sequence
  targeting sequence with TTCN PAM
ucauuaaucuuuuucugauc

SEQ ID NO: 21057 - RNA, 20 nt, Artificial Sequence
  targeting sequence with TTCN PAM
uuaaucuuuuucugauccuc

SEQ ID NO: 21058 - RNA, 20 nt, Artificial Sequence
  targeting sequence with TTCN PAM
gauccucuccuugaauuaaa

SEQ ID NO: 21059 - RNA, 20 nt, Artificial Sequence
  targeting sequence with TTCN PAM
aggagaggaucagaaaaaga

SEQ ID NO: 21060 - RNA, 20 nt, Artificial Sequence
  targeting sequence with TTCN PAM
acagcauuuuaauucaagga

SEQ ID NO: 21061 - RNA, 20 nt, Artificial Sequence
  targeting sequence with TTCN PAM
auugcuguugagacaacaaa

SEQ ID NO: 21062 - RNA, 20 nt, Artificial Sequence
  targeting sequence with TTCN PAM
acucguaaccucacucuggu

SEQ ID NO: 21063 - RNA, 20 nt, Artificial Sequence
  targeting sequence with TTCN PAM
ccuguuaaacuucuacucgu

SEQ ID NO: 21064 - RNA, 20 nt, Artificial Sequence
  targeting sequence with TTCN PAM
uucgccuguuaaacuucuac

SEQ ID NO: 21065 - RNA, 20 nt, Artificial Sequence
  targeting sequence with TTCN PAM
cuuucuuucgccuguuaaac

SEQ ID NO: 21066 - RNA, 20 nt, Artificial Sequence
  targeting sequence with TTCN PAM
cgaaaaaaugaguugccacc

SEQ ID NO: 21067 - RNA, 20 nt, Artificial Sequence
  targeting sequence with TTCN PAM
agaacgcugucagcugcagu

SEQ ID NO: 21068 - RNA, 20 nt, Artificial Sequence
  targeting sequence with TTCN PAM
ccacagagguggcaacucau

SEQ ID NO: 21069 - RNA, 20 nt, Artificial Sequence
  targeting sequence with TTCN PAM
uuugcauaacuuucgaaaaa

SEQ ID NO: 21070 - RNA, 20 nt, Artificial Sequence
  targeting sequence with TTCN PAM
aaaaacugguuagggcuagg

SEQ ID NO: 21071 - RNA, 20 nt, Artificial Sequence
  targeting sequence with TTCN PAM
aaaguuaugcaaaugaaaca

SEQ ID NO: 21072 - RNA, 20 nt, Artificial Sequence
  targeting sequence with TTCN PAM
cacccaaugcaaaugacaca

SEQ ID NO: 21073 - RNA, 20 nt, Artificial Sequence
  targeting sequence with TTCN PAM
uuacuguacacguggugaca

SEQ ID NO: 21074 - RNA, 20 nt, Artificial Sequence
  targeting sequence with TTCN PAM
guccucccuuuaauuuguca

SEQ ID NO: 21075 - RNA, 20 nt, Artificial Sequence
  targeting sequence with TTCN PAM
acauggagguucuguccucc

SEQ ID NO: 21076 - RNA, 20 nt, Artificial Sequence
  targeting sequence with TTCN PAM
auuggcacagcugccggcau

SEQ ID NO: 21077 - RNA, 20 nt, Artificial Sequence
  targeting sequence with TTCN PAM
ccagugcaagcuuccagcuu

SEQ ID NO: 21078 - RNA, 20 nt, Artificial Sequence
  targeting sequence with TTCN PAM
agcuugccuuuuuauuuauu

SEQ ID NO: 21079 - RNA, 20 nt, Artificial Sequence
  targeting sequence with TTCN PAM
uccgucgcccagacuggagu

SEQ ID NO: 21080 - RNA, 20 nt, Artificial Sequence
  targeting sequence with TTCN PAM
agugauucuccugccucagc

SEQ ID NO: 21081 - RNA, 20 nt, Artificial Sequence
  targeting sequence with TTCN PAM
ccugccucagccucucgagu

SEQ ID NO: 21082 - RNA, 20 nt, Artificial Sequence
  targeting sequence with TTCN PAM
cuauguuggccaggcugguc

SEQ ID NO: 21083 - RNA, 20 nt, Artificial Sequence
  targeting sequence with TTCN PAM
agaccagccuggccaacaua

SEQ ID NO: 21084 - RNA, 20 nt, Artificial Sequence
  targeting sequence with TTCN PAM
uccugccuuggccucccaga

SEQ ID NO: 21085 - RNA, 20 nt, Artificial Sequence
  targeting sequence with TTCN PAM
ggcugcucuuuguuagaaaa

SEQ ID NO: 21086 - RNA, 20 nt, Artificial Sequence
  targeting sequence with TTCN PAM
aacaaagagcagccugaaaa

SEQ ID NO: 21087 - RNA, 20 nt, Artificial Sequence
  targeting sequence with TTCN PAM
ugggcugcuuuuuauuaaaa

SEQ ID NO: 21088 - RNA, 20 nt, Artificial Sequence
  targeting sequence with TTCN PAM
cuuuuaauaaaaagcagccc

SEQ ID NO: 21089 - RNA, 20 nt, Artificial Sequence
  targeting sequence with TTCN PAM
gccgaagacucuuuuaccuu

SEQ ID NO: 21090 - RNA, 20 nt, Artificial Sequence
  targeting sequence with TTCN PAM
gcagaacuucccuuuuaaua

SEQ ID NO: 21091 - RNA, 20 nt, Artificial Sequence
  targeting sequence with TTCN PAM
cuaucuggcuaaauaauuuc

SEQ ID NO: 21092 - RNA, 20 nt, Artificial Sequence
  targeting sequence with TTCN PAM
uucuagcuccuguaucacug

SEQ ID NO: 21093 - RNA, 20 nt, Artificial Sequence
  targeting sequence with TTCN PAM
agcuccuguaucacugcguc

SEQ ID NO: 21094 - RNA, 20 nt, Artificial Sequence
  targeting sequence with TTCN PAM
uccuucgaauccuguuuuca

SEQ ID NO: 21095 - RNA, 20 nt, Artificial Sequence
  targeting sequence with TTCN PAM
aauccuguuuucaugugucu

SEQ ID NO: 21096 - RNA, 20 nt, Artificial Sequence
  targeting sequence with TTCN PAM
aaggaggaagacgcagugau

SEQ ID NO: 21097 - RNA, 20 nt, Artificial Sequence
  targeting sequence with TTCN PAM
ugugucucuuaaagccuuua

SEQ ID NO: 21098 - RNA, 20 nt, Artificial Sequence
  targeting sequence with TTCN PAM
guauuucauccaaucuaaua

SEQ ID NO: 21099 - RNA, 20 nt, Artificial Sequence
  targeting sequence with TTCN PAM
uccaaucuaauaggucauug

SEQ ID NO: 21100 - RNA, 20 nt, Artificial Sequence
  targeting sequence with TTCN PAM
uauugauacacaaaacaaug

SEQ ID NO: 21101 - RNA, 20 nt, Artificial Sequence
  targeting sequence with TTCN PAM
guguaacuggcagcauuuuu

SEQ ID NO: 21102 - RNA, 20 nt, Artificial Sequence
  targeting sequence with TTCN PAM
caccucuaagguugugucuu

SEQ ID NO: 21103 - RNA, 20 nt, Artificial Sequence
  targeting sequence with TTCN PAM
cauuuucucaccucuaaggu

SEQ ID NO: 21104 - RNA, 20 nt, Artificial Sequence
  targeting sequence with TTCN PAM
aaagcuuacauuuuuuuuuc

SEQ ID NO: 21105 - RNA, 20 nt, Artificial Sequence
  targeting sequence with TTCN PAM
uugugaaagugucuguuuca

SEQ ID NO: 21106 - RNA, 20 nt, Artificial Sequence
  targeting sequence with TTCN PAM
caaagaacuaccauauguca

SEQ ID NO: 21107 - RNA, 20 nt, Artificial Sequence
  targeting sequence with TTCN PAM
caccuucucacuggauagua

SEQ ID NO: 21108 - RNA, 20 nt, Artificial Sequence
  targeting sequence with TTCN PAM
cacuggauaguaauuucccu

SEQ ID NO: 21109 - RNA, 20 nt, Artificial Sequence
  targeting sequence with TTCN PAM
cugaggggagggagggauua

SEQ ID NO: 21110 - RNA, 20 nt, Artificial Sequence
  targeting sequence with TTCN PAM
uaucuguuggugccuggcac

SEQ ID NO: 21111 - RNA, 20 nt, Artificial Sequence
  targeting sequence with TTCN PAM
cucauguugucuagccuuua

SEQ ID NO: 21112 - RNA, 20 nt, Artificial Sequence
  targeting sequence with TTCN PAM
aauaauaucauaaaggcuag

SEQ ID NO: 21113 - RNA, 20 nt, Artificial Sequence
  targeting sequence with TTCN PAM
aagggucaacuguugagggu

SEQ ID NO: 21114 - RNA, 20 nt, Artificial Sequence
  targeting sequence with TTCN PAM
ugugucuggcuucuggacaa

SEQ ID NO: 21115 - RNA, 20 nt, Artificial Sequence
  targeting sequence with TTCN PAM
ggacaagaggaaaucaggac

SEQ ID NO: 21116 - RNA, 20 nt, Artificial Sequence
  targeting sequence with TTCN PAM
ucuuguccagaagccagaca

SEQ ID NO: 21117 - RNA, 20 nt, Artificial Sequence
  targeting sequence with TTCN PAM
aucaugauccacucaguagu

SEQ ID NO: 21118 - RNA, 20 nt, Artificial Sequence
  targeting sequence with TTCN PAM
accgccacaccacagcagcc

SEQ ID NO: 21119 - RNA, 20 nt, Artificial Sequence
  targeting sequence with TTCN PAM
auucaaccgccacaccacag

SEQ ID NO: 21120 - RNA, 20 nt, Artificial Sequence
  targeting sequence with TTCN PAM
uaguuauucuuuuucuccuc

SEQ ID NO: 21121 - RNA, 20 nt, Artificial Sequence
  targeting sequence with TTCN PAM
uuuucuccucaguacacaca

SEQ ID NO: 21122 - RNA, 20 nt, Artificial Sequence
  targeting sequence with TTCN PAM
ccucaguacacacacagugu

SEQ ID NO: 21123 - RNA, 20 nt, Artificial Sequence
  targeting sequence with TTCN PAM
uaauggcaauaaaguuuacu

SEQ ID NO: 21124 - RNA, 20 nt, Artificial Sequence
  targeting sequence with TTCN PAM
uggccauuagcagacuucau

SEQ ID NO: 21125 - RNA, 20 nt, Artificial Sequence
  targeting sequence with TTCN PAM
ucauuuugguuccuaauugu

SEQ ID NO: 21126 - RNA, 20 nt, Artificial Sequence
  targeting sequence with TTCN PAM
uaauugucuuuuucccuugu

SEQ ID NO: 21127 - RNA, 20 nt, Artificial Sequence
  targeting sequence with TTCN PAM
cuugucuucuguucaguaua

SEQ ID NO: 21128 - RNA, 20 nt, Artificial Sequence
  targeting sequence with TTCN PAM
guucaguauaaaugacaucg

SEQ ID NO: 21129 - RNA, 20 nt, Artificial Sequence
  targeting sequence with TTCN PAM
guauaaaugacaucgcauuu

SEQ ID NO: 21130 - RNA, 20 nt, Artificial Sequence
  targeting sequence with TTCN PAM
aucaggcuuaaaugcgaugu

SEQ ID NO: 21131 - RNA, 20 nt, Artificial Sequence
  targeting sequence with TTCN PAM
ggcagccaaaaucaguugag

SEQ ID NO: 21132 - RNA, 20 nt, Artificial Sequence
  targeting sequence with TTCN PAM
ucuuaaagugcuucccuaac

SEQ ID NO: 21133 - RNA, 20 nt, Artificial Sequence
  targeting sequence with TTCN PAM
cuaaccucccucuugugagu

SEQ ID NO: 21134 - RNA, 20 nt, Artificial Sequence
  targeting sequence with TTCN PAM
gaguacucacaagagggagg

SEQ ID NO: 21135 - RNA, 20 nt, Artificial Sequence
  targeting sequence with TTCN PAM
acccuugccuuuuuaaucuc

SEQ ID NO: 21136 - RNA, 20 nt, Artificial Sequence
  targeting sequence with TTCN PAM
cuauuacuuuuuaauaggga

SEQ ID NO: 21137 - RNA, 20 nt, Artificial Sequence
  targeting sequence with TTCN PAM
aucccuauuaaaaaguaaua

SEQ ID NO: 21138 - RNA, 20 nt, Artificial Sequence
  targeting sequence with TTCN PAM
uaucugauaguuuacuugcc

SEQ ID NO: 21139 - RNA, 20 nt, Artificial Sequence
  targeting sequence with TTCN PAM
cagguucuuaucugauaguu

SEQ ID NO: 21140 - RNA, 20 nt, Artificial Sequence
  targeting sequence with TTCN PAM
ucuuucccuuuuuacuuuga

SEQ ID NO: 21141 - RNA, 20 nt, Artificial Sequence
  targeting sequence with TTCN PAM
cuuuuuacuuugagacaccc

SEQ ID NO: 21142 - RNA, 20 nt, Artificial Sequence
  targeting sequence with TTCN PAM
ugggugucucaaaguaaaaa

SEQ ID NO: 21143 - RNA, 20 nt, Artificial Sequence
  targeting sequence with TTCN PAM
acucuuucaugggugucuca

SEQ ID NO: 21144 - RNA, 20 nt, Artificial Sequence
  targeting sequence with TTCN PAM
aaggcauugugauuguuuuc

SEQ ID NO: 21145 - RNA, 20 nt, Artificial Sequence
  targeting sequence with TTCN PAM
gggggacaaaauguaaacug

SEQ ID NO: 21146 - RNA, 20 nt, Artificial Sequence
  targeting sequence with TTCN PAM
agcaacaggacugacggugc

SEQ ID NO: 21147 - RNA, 20 nt, Artificial Sequence
  targeting sequence with TTCN PAM
uggacacagcaccgucaguc

SEQ ID NO: 21148 - RNA, 20 nt, Artificial Sequence
  targeting sequence with TTCN PAM
auauggauguuguccuauuu

SEQ ID NO: 21149 - RNA, 20 nt, Artificial Sequence
  targeting sequence with TTCN PAM
uauuuucaaauaacauaagc

SEQ ID NO: 21150 - RNA, 20 nt, Artificial Sequence
  targeting sequence with TTCN PAM
aauaacauaagcucccucug

SEQ ID NO: 21151 - RNA, 20 nt, Artificial Sequence
  targeting sequence with TTCN PAM
agagggagcuuauguuauuu

SEQ ID NO: 21152 - RNA, 20 nt, Artificial Sequence
  targeting sequence with TTCN PAM
gagaaccccuuauguuugac

SEQ ID NO: 21153 - RNA, 20 nt, Artificial Sequence
  targeting sequence with TTCN PAM
cugaaaauuacuuuuauaua

SEQ ID NO: 21154 - RNA, 20 nt, Artificial Sequence
  targeting sequence with TTCN PAM
gucuaagucuacuuccucuu

SEQ ID NO: 21155 - RNA, 20 nt, Artificial Sequence
  targeting sequence with TTCN PAM
ucuucucuguugucucuaga

SEQ ID NO: 21156 - RNA, 20 nt, Artificial Sequence
  targeting sequence with TTCN PAM
cuguugucucuagauacgca

SEQ ID NO: 21157 - RNA, 20 nt, Artificial Sequence
  targeting sequence with TTCN PAM
uuguaugguuaacuacauaa

SEQ ID NO: 21158 - RNA, 20 nt, Artificial Sequence
  targeting sequence with TTCN PAM
gcagacuucucuccagugua

SEQ ID NO: 21159 - RNA, 20 nt, Artificial Sequence
  targeting sequence with TTCN PAM
cuccaguguaaacaauccaa

SEQ ID NO: 21160 - RNA, 20 nt, Artificial Sequence
  targeting sequence with TTCN PAM
acauagguuaucuuuuccaa

SEQ ID NO: 21161 - RNA, 20 nt, Artificial Sequence
  targeting sequence with TTCN PAM
aauacucuaaccauuucaga

SEQ ID NO: 21162 - RNA, 20 nt, Artificial Sequence
  targeting sequence with TTCN PAM
gaaaguuuccgcuugauuuc

SEQ ID NO: 21163 - RNA, 20 nt, Artificial Sequence
  targeting sequence with TTCN PAM
gaaaugguuagaguauugga

SEQ ID NO: 21164 - RNA, 20 nt, Artificial Sequence
  targeting sequence with TTCN PAM
gcuugauuucucagauggug

SEQ ID NO: 21165 - RNA, 20 nt, Artificial Sequence
  targeting sequence with TTCN PAM
cagauggugugugugugugu

SEQ ID NO: 21166 - RNA, 20 nt, Artificial Sequence
  targeting sequence with TTCN PAM
caccauucuccugccucagc

SEQ ID NO: 21167 - RNA, 20 nt, Artificial Sequence
  targeting sequence with TTCN PAM
ccugccucagccuccugagu

SEQ ID NO: 21168 - RNA, 20 nt, Artificial Sequence
  targeting sequence with TTCN PAM
ccguguuagccaggaugguc

SEQ ID NO: 21169 - RNA, 20 nt, Artificial Sequence
  targeting sequence with TTCN PAM
uagagacaggguugugcucu

SEQ ID NO: 21170 - RNA, 20 nt, Artificial Sequence
  targeting sequence with TTCN PAM
caccucagccucccgaguag

SEQ ID NO: 21171 - RNA, 20 nt, Artificial Sequence
  targeting sequence with TTCN PAM
ugguuacccaacuuuaaguc

SEQ ID NO: 21172 - RNA, 20 nt, Artificial Sequence
  targeting sequence with TTCN PAM
aaaucuguagccaauaaaaa

SEQ ID NO: 21173 - RNA, 20 nt, Artificial Sequence
  targeting sequence with TTCN PAM
ugcaggguugcuacugcuau

SEQ ID NO: 21174 - RNA, 20 nt, Artificial Sequence
  targeting sequence with TTCN PAM
gacuaauagauaucacauag

SEQ ID NO: 21175 - RNA, 20 nt, Artificial Sequence
  targeting sequence with TTCN PAM
gccccucaagggacacaaag

SEQ ID NO: 21176 - RNA, 20 nt, Artificial Sequence
  targeting sequence with TTCN PAM
cauaugccacacaguacaca

SEQ ID NO: 21177 - RNA, 20 nt, Artificial Sequence
  targeting sequence with TTCN PAM
auucucuauaauagccucau

SEQ ID NO: 21178 - RNA, 20 nt, Artificial Sequence
  targeting sequence with TTCN PAM
cuauaauagccucaucauug

SEQ ID NO: 21179 - RNA, 20 nt, Artificial Sequence
  targeting sequence with TTCN PAM
ucaccuguccucaucucaau

SEQ ID NO: 21180 - RNA, 20 nt, Artificial Sequence
  targeting sequence with TTCN PAM
aagucuuuuuccucaccugu

SEQ ID NO: 21181 - RNA, 20 nt, Artificial Sequence
  targeting sequence with TTCN PAM
auuuugacugagaaucaaaa

SEQ ID NO: 21182 - RNA, 20 nt, Artificial Sequence
  targeting sequence with TTCN PAM
guaguuccauuuugacugag

SEQ ID NO: 21183 - RNA, 20 nt, Artificial Sequence
  targeting sequence with TTCN PAM
ucagugaaauaggaagcaac

SEQ ID NO: 21184 - RNA, 20 nt, Artificial Sequence
  targeting sequence with TTCN PAM
gugaaauaggaagcaacagc

SEQ ID NO: 21185 - RNA, 20 nt, Artificial Sequence
  targeting sequence with TTCN PAM
cugaagaaaaaaaaaaugga

SEQ ID NO: 21186 - RNA, 20 nt, Artificial Sequence
  targeting sequence with TTCN PAM
uauuucacugaagaaaaaaa

SEQ ID NO: 21187 - RNA, 20 nt, Artificial Sequence
  targeting sequence with TTCN PAM
ccauugccacucucaguugc

SEQ ID NO: 21188 - RNA, 20 nt, Artificial Sequence
  targeting sequence with TTCN PAM
gagaguugaagagaaaggga

SEQ ID NO: 21189 - RNA, 20 nt, Artificial Sequence
  targeting sequence with TTCN PAM
acucucugaaaccucccuuc

SEQ ID NO: 21190 - RNA, 20 nt, Artificial Sequence
  targeting sequence with TTCN PAM
cuucaacucucugaaaccuc

SEQ ID NO: 21191 - RNA, 20 nt, Artificial Sequence
  targeting sequence with TTCN PAM
cuuucucuucaacucucuga

SEQ ID NO: 21192 - RNA, 20 nt, Artificial Sequence
  targeting sequence with TTCN PAM
cugaggcagugacuuuacac

SEQ ID NO: 21193 - RNA, 20 nt, Artificial Sequence
  targeting sequence with TTCN PAM
gccucuacaacuaugcagcu

SEQ ID NO: 21194 - RNA, 20 nt, Artificial Sequence
  targeting sequence with TTCN PAM
ccucuucugccucuacaacu

SEQ ID NO: 21195 - RNA, 20 nt, Artificial Sequence
  targeting sequence with TTCN PAM
aaugugcuugcaaaaccacc

SEQ ID NO: 21196 - RNA, 20 nt, Artificial Sequence
  targeting sequence with TTCN PAM
ucuucaaaugugcuugcaaa

SEQ ID NO: 21197 - RNA, 20 nt, Artificial Sequence
  targeting sequence with TTCN PAM
caacccaccugguaccccaa

SEQ ID NO: 21198 - RNA, 20 nt, Artificial Sequence
  targeting sequence with TTCN PAM
uucccaacccaccugguacc

SEQ ID NO: 21199 - RNA, 20 nt, Artificial Sequence
  targeting sequence with TTCN PAM
cuuccuucccaacccaccug

SEQ ID NO: 21200 - RNA, 20 nt, Artificial Sequence
  targeting sequence with TTCN PAM
ugcaccacuucccuuccuuc

SEQ ID NO: 21201 - RNA, 20 nt, Artificial Sequence
  targeting sequence with TTCN PAM
cacuaauccuaugcuguggg

SEQ ID NO: 21202 - RNA, 20 nt, Artificial Sequence
  targeting sequence with TTCN PAM
gugagucugagcugguuauu

SEQ ID NO: 21203 - RNA, 20 nt, Artificial Sequence
  targeting sequence with TTCN PAM
ucauguaucaaauggauaac

SEQ ID NO: 21204 - RNA, 20 nt, Artificial Sequence
  targeting sequence with TTCN PAM
uguaucaaauggauaacauu

SEQ ID NO: 21205 - RNA, 20 nt, Artificial Sequence
  targeting sequence with TTCN PAM
aucugauuaucaaagaggcc

SEQ ID NO: 21206 - RNA, 20 nt, Artificial Sequence
  targeting sequence with TTCN PAM
agaaagaugcaaauucuuca

SEQ ID NO: 21207 - RNA, 20 nt, Artificial Sequence
  targeting sequence with TTCN PAM
agaaaguggucuaaagcuuc

SEQ ID NO: 21208 - RNA, 20 nt, Artificial Sequence
  targeting sequence with TTCN PAM
ucauguguaugcagaauuuc

SEQ ID NO: 21209 - RNA, 20 nt, Artificial Sequence
  targeting sequence with TTCN PAM
uguguaugcagaauuucaug

SEQ ID NO: 21210 - RNA, 20 nt, Artificial Sequence
  targeting sequence with TTCN PAM
cuuuaguccugcauaaagac

SEQ ID NO: 21211 - RNA, 20 nt, Artificial Sequence
  targeting sequence with TTCN PAM
guaggauuauaggcaugagc

SEQ ID NO: 21212 - RNA, 20 nt, Artificial Sequence
  targeting sequence with TTCN PAM
caacucaggcucccagagcu

SEQ ID NO: 21213 - RNA, 20 nt, Artificial Sequence
  targeting sequence with TTCN PAM
ugcuucauagucaggugugc

SEQ ID NO: 21214 - RNA, 20 nt, Artificial Sequence
  targeting sequence with TTCN PAM
uagucaggugugcuguacca

SEQ ID NO: 21215 - RNA, 20 nt, Artificial Sequence
  targeting sequence with TTCN PAM
aguucagaauaauguuuuag

SEQ ID NO: 21216 - RNA, 20 nt, Artificial Sequence
  targeting sequence with TTCN PAM
gaauaauguuuuagggagac

SEQ ID NO: 21217 - RNA, 20 nt, Artificial Sequence
  targeting sequence with TTCN PAM
gaacuugaacucaaacaugc

SEQ ID NO: 21218 - RNA, 20 nt, Artificial Sequence
  targeting sequence with TTCN PAM
gcucuccaggcucccuccuc

SEQ ID NO: 21219 - RNA, 20 nt, Artificial Sequence
  targeting sequence with TTCN PAM
gucucauccuaguggcuguu

SEQ ID NO: 21220 - RNA, 20 nt, Artificial Sequence
  targeting sequence with TTCN PAM
ucaacagccacuaggaugag

SEQ ID NO: 21221 - RNA, 20 nt, Artificial Sequence
  targeting sequence with TTCN PAM
guaccuacugggccuuauac

SEQ ID NO: 21222 - RNA, 20 nt, Artificial Sequence
  targeting sequence with TTCN PAM
aacaacucucugaagcaggc

SEQ ID NO: 21223 - RNA, 20 nt, Artificial Sequence
  targeting sequence with TTCN PAM
gagaguuguuggaagcauca

SEQ ID NO: 21224 - RNA, 20 nt, Artificial Sequence
  targeting sequence with TTCN PAM
caucuuugagcggagauaag

SEQ ID NO: 21225 - RNA, 20 nt, Artificial Sequence
  targeting sequence with TTCN PAM
cugacugcagagucuuuguu

SEQ ID NO: 21226 - RNA, 20 nt, Artificial Sequence
  targeting sequence with TTCN PAM
uucuaguguaucaugcugcc

SEQ ID NO: 21227 - RNA, 20 nt, Artificial Sequence
  targeting sequence with TTCN PAM
aguguaucaugcugccucuu

SEQ ID NO: 21228 - RNA, 20 nt, Artificial Sequence
  targeting sequence with TTCN PAM
ugaacaaaaaaacuaugucu

SEQ ID NO: 21229 - RNA, 20 nt, Artificial Sequence
  targeting sequence with TTCN PAM
uauuauauuguuuuucuuga

SEQ ID NO: 21230 - RNA, 20 nt, Artificial Sequence
  targeting sequence with TTCN PAM
ucauauuauauuguuuuucu

SEQ ID NO: 21231 - RNA, 20 nt, Artificial Sequence
  targeting sequence with TTCN PAM
auuauuucuucauauuauau

SEQ ID NO: 21232 - RNA, 20 nt, Artificial Sequence
  targeting sequence with TTCN PAM
auuccaggcccaguucuaag

SEQ ID NO: 21233 - RNA, 20 nt, Artificial Sequence
  targeting sequence with TTCN PAM
aggcccaguucuaagcaaca

SEQ ID NO: 21234 - RNA, 20 nt, Artificial Sequence
  targeting sequence with TTCN PAM
aagcaacauaaggguuaggg

SEQ ID NO: 21235 - RNA, 20 nt, Artificial Sequence
  targeting sequence with TTCN PAM
gaaccccccaaaacuuuacu

SEQ ID NO: 21236 - RNA, 20 nt, Artificial Sequence
  targeting sequence with TTCN PAM
gaaauuacaugcagauuuuu

SEQ ID NO: 21237 - RNA, 20 nt, Artificial Sequence
  targeting sequence with TTCN PAM
uaaaauaagcuagauaaaau

SEQ ID NO: 21238 - RNA, 20 nt, Artificial Sequence
  targeting sequence with TTCN PAM
caauuaacauuuuaucuagc

SEQ ID NO: 21239 - RNA, 20 nt, Artificial Sequence
  targeting sequence with TTCN PAM
uuuuucucaauuaacauuuu

SEQ ID NO: 21240 - RNA, 20 nt, Artificial Sequence
  targeting sequence with TTCN PAM
uuaaauggaaguggaucauc

SEQ ID NO: 21241 - RNA, 20 nt, Artificial Sequence
  targeting sequence with TTCN PAM
auuuaaugaagaguaaauau

SEQ ID NO: 21242 - RNA, 20 nt, Artificial Sequence
  targeting sequence with TTCN PAM
ucuucauugucuucagguug

SEQ ID NO: 21243 - RNA, 20 nt, Artificial Sequence
  targeting sequence with TTCN PAM
uugucuucagguugaauagg

SEQ ID NO: 21244 - RNA, 20 nt, Artificial Sequence
  targeting sequence with TTCN PAM
gguugaauaggcugaggagg

SEQ ID NO: 21245 - RNA, 20 nt, Artificial Sequence
  targeting sequence with TTCN PAM
accugaagacaaugaagaug

SEQ ID NO: 21246 - RNA, 20 nt, Artificial Sequence
  targeting sequence with TTCN PAM
uccuccuccuccuccuccuc

SEQ ID NO: 21247 - RNA, 20 nt, Artificial Sequence
  targeting sequence with TTCN PAM
uuugccucugucucccuggc

SEQ ID NO: 21248 - RNA, 20 nt, Artificial Sequence
  targeting sequence with TTCN PAM
cauguaaaaguggacucaug

SEQ ID NO: 21249 - RNA, 20 nt, Artificial Sequence
  targeting sequence with TTCN PAM
ggggucaacuguauguacac

SEQ ID NO: 21250 - RNA, 20 nt, Artificial Sequence
  targeting sequence with TTCN PAM
caccaaccaugagguaaaua

SEQ ID NO: 21251 - RNA, 20 nt, Artificial Sequence
  targeting sequence with TTCN PAM
aauaaggaaaugaaagcucu

SEQ ID NO: 21252 - RNA, 20 nt, Artificial Sequence
  targeting sequence with TTCN PAM
uuauuugaaaaauggauaca

SEQ ID NO: 21253 - RNA, 20 nt, Artificial Sequence
  targeting sequence with TTCN PAM
uuuccuuauuugaaaaaugg

SEQ ID NO: 21254 - RNA, 20 nt, Artificial Sequence
  targeting sequence with TTCN PAM
guagcuuguuugggucaugc

SEQ ID NO: 21255 - RNA, 20 nt, Artificial Sequence
  targeting sequence with TTCN PAM
ucaccaucaccugcuaccua

SEQ ID NO: 21256 - RNA, 20 nt, Artificial Sequence
  targeting sequence with TTCN PAM
aucacuccucccucauccug

SEQ ID NO: 21257 - RNA, 20 nt, Artificial Sequence
  targeting sequence with TTCN PAM
uuguuuauuuaguauuugca

SEQ ID NO: 21258 - RNA, 20 nt, Artificial Sequence
  targeting sequence with TTCN PAM
gcuacuguaaaagguacuug

SEQ ID NO: 21259 - RNA, 20 nt, Artificial Sequence
  targeting sequence with TTCN PAM
caaagugcugagaucacaag

SEQ ID NO: 21260 - RNA, 20 nt, Artificial Sequence
  targeting sequence with TTCN PAM
ucagagucuuuuuaugggag

SEQ ID NO: 21261 - RNA, 20 nt, Artificial Sequence
  targeting sequence with TTCN PAM
ucuguguuucagaugaaggc

SEQ ID NO: 21262 - RNA, 20 nt, Artificial Sequence
  targeting sequence with TTCN PAM
gaugaaggcauugaggcuca

SEQ ID NO: 21263 - RNA, 20 nt, Artificial Sequence
  targeting sequence with TTCN PAM
ucugaaacacagaggaacag

SEQ ID NO: 21264 - RNA, 20 nt, Artificial Sequence
  targeting sequence with TTCN PAM
cugagccucaaugccuucau

SEQ ID NO: 21265 - RNA, 20 nt, Artificial Sequence
  targeting sequence with TTCN PAM
acuugcccugugaauaaagu

SEQ ID NO: 21266 - RNA, 20 nt, Artificial Sequence
  targeting sequence with TTCN PAM
cagggcaaguggaaggugac

SEQ ID NO: 21267 - RNA, 20 nt, Artificial Sequence
  targeting sequence with TTCN PAM
guacaucuuaaggacuuuua

SEQ ID NO: 21268 - RNA, 20 nt, Artificial Sequence
  targeting sequence with TTCN PAM
uucauaaagcccaaguagua

SEQ ID NO: 21269 - RNA, 20 nt, Artificial Sequence
  targeting sequence with TTCN PAM
uaaagcccaaguaguaugaa

SEQ ID NO: 21270 - RNA, 20 nt, Artificial Sequence
  targeting sequence with TTCN PAM
uacuacuugggcuuuaugaa

SEQ ID NO: 21271 - RNA, 20 nt, Artificial Sequence
  targeting sequence with TTCN PAM
cauuuucauacuacuugggc

SEQ ID NO: 21272 - RNA, 20 nt, Artificial Sequence
  targeting sequence with TTCN PAM
uuggcuucccauugcuuuag

SEQ ID NO: 21273 - RNA, 20 nt, Artificial Sequence
  targeting sequence with TTCN PAM
cauugcuuuaggauaaagag

SEQ ID NO: 21274 - RNA, 20 nt, Artificial Sequence
  targeting sequence with TTCN PAM
cucagacaugccaggcuuuu

SEQ ID NO: 21275 - RNA, 20 nt, Artificial Sequence
  targeting sequence with TTCN PAM
ugcuucagggccuuugcaca

SEQ ID NO: 21276 - RNA, 20 nt, Artificial Sequence
  targeting sequence with TTCN PAM
gggccuuugcacaucuguuc

SEQ ID NO: 21277 - RNA, 20 nt, Artificial Sequence
  targeting sequence with TTCN PAM
auccauguggaugggucugu

SEQ ID NO: 21278 - RNA, 20 nt, Artificial Sequence
  targeting sequence with TTCN PAM
guggagaccuaaaggaugag

SEQ ID NO: 21279 - RNA, 20 nt, Artificial Sequence
  targeting sequence with TTCN PAM
cuaaggaugagauccuucag

SEQ ID NO: 21280 - RNA, 20 nt, Artificial Sequence
  targeting sequence with TTCN PAM
cucaucuaaauuaggucccc

SEQ ID NO: 21281 - RNA, 20 nt, Artificial Sequence
  targeting sequence with TTCN PAM
gucagacaaaaggaguacau

SEQ ID NO: 21282 - RNA, 20 nt, Artificial Sequence
  targeting sequence with TTCN PAM
cggccaggaauagauuuuaa

SEQ ID NO: 21283 - RNA, 20 nt, Artificial Sequence
  targeting sequence with TTCN PAM
uggccgggaacaguggcuca

SEQ ID NO: 21284 - RNA, 20 nt, Artificial Sequence
  targeting sequence with TTCN PAM
cacuauaaaaaaauaaguau

SEQ ID NO: 21285 - RNA, 20 nt, Artificial Sequence
  targeting sequence with TTCN PAM
ccaguuauucucuuucauag

SEQ ID NO: 21286 - RNA, 20 nt, Artificial Sequence
  targeting sequence with TTCN PAM
cuuucauaggauccgugucu

SEQ ID NO: 21287 - RNA, 20 nt, Artificial Sequence
  targeting sequence with TTCN PAM
uaggauccgugucuuaccau

SEQ ID NO: 21288 - RNA, 20 nt, Artificial Sequence
  targeting sequence with TTCN PAM
uuaagguaccuaguaagugu

SEQ ID NO: 21289 - RNA, 20 nt, Artificial Sequence
  targeting sequence with TTCN PAM
aaagaauucucucugggaaa

SEQ ID NO: 21290 - RNA, 20 nt, Artificial Sequence
  targeting sequence with TTCN PAM
uuagaaaacuaguucuuuaa

SEQ ID NO: 21291 - RNA, 20 nt, Artificial Sequence
  targeting sequence with TTCN PAM
cucugggaaaugcugguuua

SEQ ID NO: 21292 - RNA, 20 nt, Artificial Sequence
  targeting sequence with TTCN PAM
cagagagaauucuuuagaaa

SEQ ID NO: 21293 - RNA, 20 nt, Artificial Sequence
  targeting sequence with TTCN PAM
auuuuacaaacacuuuuagg

SEQ ID NO: 21294 - RNA, 20 nt, Artificial Sequence
  targeting sequence with TTCN PAM
ggaucagcugacaaaagcgu

SEQ ID NO: 21295 - RNA, 20 nt, Artificial Sequence
  targeting sequence with TTCN PAM
aguuuugauguccagauaau

SEQ ID NO: 21296 - RNA, 20 nt, Artificial Sequence
  targeting sequence with TTCN PAM
gaaguacacguaaguaacuu

SEQ ID NO: 21297 - RNA, 20 nt, Artificial Sequence
  targeting sequence with TTCN PAM
gaaugccuuccaguuuugau

SEQ ID NO: 21298 - RNA, 20 nt, Artificial Sequence
  targeting sequence with TTCN PAM
auuuaagagaaaaaaguuuu

SEQ ID NO: 21299 - RNA, 20 nt, Artificial Sequence
  targeting sequence with TTCN PAM
aguucaauuuaagagaaaaa

SEQ ID NO: 21300 - RNA, 20 nt, Artificial Sequence
  targeting sequence with TTCN PAM
uauaccaaccacacacaccc

SEQ ID NO: 21301 - RNA, 20 nt, Artificial Sequence
  targeting sequence with TTCN PAM
cuacucaaccuuccuauacc

SEQ ID NO: 21302 - RNA, 20 nt, Artificial Sequence
  targeting sequence with TTCN PAM
uuaacuuauucacuacucaa

SEQ ID NO: 21303 - RNA, 20 nt, Artificial Sequence
  targeting sequence with TTCN PAM
uggccacuuacuggcguggc

SEQ ID NO: 21304 - RNA, 20 nt, Artificial Sequence
  targeting sequence with TTCN PAM
ucugacauuguagacuuuau

SEQ ID NO: 21305 - RNA, 20 nt, Artificial Sequence
  targeting sequence with TTCN PAM
agugucccugucucagagaa

SEQ ID NO: 21306 - RNA, 20 nt, Artificial Sequence
  targeting sequence with TTCN PAM
cugagacagggacacuggaa

SEQ ID NO: 21307 - RNA, 20 nt, Artificial Sequence
  targeting sequence with TTCN PAM
gacauuugacacugggugga

SEQ ID NO: 21308 - RNA, 20 nt, Artificial Sequence
  targeting sequence with TTCN PAM
auaagaacagauacugcauc

SEQ ID NO: 21309 - RNA, 20 nt, Artificial Sequence
  targeting sequence with TTCN PAM
uauggaacuuacaggccgau

SEQ ID NO: 21310 - RNA, 20 nt, Artificial Sequence
  targeting sequence with TTCN PAM
gucuugcucugucucccagg

SEQ ID NO: 21311 - RNA, 20 nt, Artificial Sequence
  targeting sequence with TTCN PAM
aggcucaaauaauccucuua

SEQ ID NO: 21312 - RNA, 20 nt, Artificial Sequence
  targeting sequence with TTCN PAM
gcuucccaaauagcuggaac

SEQ ID NO: 21313 - RNA, 20 nt, Artificial Sequence
  targeting sequence with TTCN PAM
caaauagcuggaacugcagg

SEQ ID NO: 21314 - RNA, 20 nt, Artificial Sequence
  targeting sequence with TTCN PAM
agcuauuugggaagcugaag

SEQ ID NO: 21315 - RNA, 20 nt, Artificial Sequence
  targeting sequence with TTCN PAM
ugguagagacaggguuucac

SEQ ID NO: 21316 - RNA, 20 nt, Artificial Sequence
  targeting sequence with TTCN PAM
cuuuguugccuguacugguc

SEQ ID NO: 21317 - RNA, 20 nt, Artificial Sequence
  targeting sequence with TTCN PAM
agaccaguacaggcaacaaa

SEQ ID NO: 21318 - RNA, 20 nt, Artificial Sequence
  targeting sequence with TTCN PAM
gacacaugcuacaacacaga

SEQ ID NO: 21319 - RNA, 20 nt, Artificial Sequence
  targeting sequence with TTCN PAM
guguuguagcaugugucaga

SEQ ID NO: 21320 - RNA, 20 nt, Artificial Sequence
  targeting sequence with TTCN PAM
gacacaugcuacaacacaga

SEQ ID NO: 21321 - RNA, 20 nt, Artificial Sequence
  targeting sequence with TTCN PAM
uuuuuuuucuuuauuauuau

SEQ ID NO: 21322 - RNA, 20 nt, Artificial Sequence
  targeting sequence with TTCN PAM
uuauuauuauuuuuuuuuau

SEQ ID NO: 21323 - RNA, 20 nt, Artificial Sequence
  targeting sequence with TTCN PAM
uaaaaaaaaauaauaauaaa

SEQ ID NO: 21324 - RNA, 20 nt, Artificial Sequence
  targeting sequence with TTCN PAM
cccuuggccgcccaaacugc

SEQ ID NO: 21325 - RNA, 20 nt, Artificial Sequence
  targeting sequence with TTCN PAM
uuccuuuuuaagucugaaua

SEQ ID NO: 21326 - RNA, 20 nt, Artificial Sequence
  targeting sequence with TTCN PAM
uuuuuaagucugaauauuau

SEQ ID NO: 21327 - RNA, 20 nt, Artificial Sequence
  targeting sequence with TTCN PAM
gacuuaaaaaggaaggaagc

SEQ ID NO: 21328 - RNA, 20 nt, Artificial Sequence
  targeting sequence with TTCN PAM
auuguauauauagaccacau

SEQ ID NO: 21329 - RNA, 20 nt, Artificial Sequence
  targeting sequence with TTCN PAM
uuauccauucaucuguugau

SEQ ID NO: 21330 - RNA, 20 nt, Artificial Sequence
  targeting sequence with TTCN PAM
ucuguugauggacacuugug

SEQ ID NO: 21331 - RNA, 20 nt, Artificial Sequence
  targeting sequence with TTCN PAM
gcuucuuagcuauuaugaau

SEQ ID NO: 21332 - RNA, 20 nt, Artificial Sequence
  targeting sequence with TTCN PAM
uagcuauuaugaauaaugcu

SEQ ID NO: 21333 - RNA, 20 nt, Artificial Sequence
  targeting sequence with TTCN PAM
uaauagcuaagaagcagaag

SEQ ID NO: 21334 - RNA, 20 nt, Artificial Sequence
  targeting sequence with TTCN PAM
uagcagcauuauucauaaua

SEQ ID NO: 21335 - RNA, 20 nt, Artificial Sequence
  targeting sequence with TTCN PAM
aaaauuguuuguugauuugu

SEQ ID NO: 21336 - RNA, 20 nt, Artificial Sequence
  targeting sequence with TTCN PAM
uucaaaaauuguuuguugau

SEQ ID NO: 21337 - RNA, 20 nt, Artificial Sequence
  targeting sequence with TTCN PAM
uuccuucaaaaauuguuugu

SEQ ID NO: 21338 - RNA, 20 nt, Artificial Sequence
  targeting sequence with TTCN PAM
uucauuccuucaaaaauugu

SEQ ID NO: 21339 - RNA, 20 nt, Artificial Sequence
  targeting sequence with TTCN PAM
cucauucauucauuccuuca

SEQ ID NO: 21340 - RNA, 20 nt, Artificial Sequence
  targeting sequence with TTCN PAM
cuuguggguaauacuuuacu

SEQ ID NO: 21341 - RNA, 20 nt, Artificial Sequence
  targeting sequence with TTCN PAM
uuguugucuaaggauuuguc

SEQ ID NO: 21342 - RNA, 20 nt, Artificial Sequence
  targeting sequence with TTCN PAM
agaucuuggucugugauguc

SEQ ID NO: 21343 - RNA, 20 nt, Artificial Sequence
  targeting sequence with TTCN PAM
uugcaccuccaucuuccauu

SEQ ID NO: 21344 - RNA, 20 nt, Artificial Sequence
  targeting sequence with TTCN PAM
auuucugggccuccacaaaa

SEQ ID NO: 21345 - RNA, 20 nt, Artificial Sequence
  targeting sequence with TTCN PAM
gggccuccacaaaacaguaa

SEQ ID NO: 21346 - RNA, 20 nt, Artificial Sequence
  targeting sequence with TTCN PAM
aaaccaaccuggccaaaagu

SEQ ID NO: 21347 - RNA, 20 nt, Artificial Sequence
  targeting sequence with TTCN PAM
uauuuguagagauggggacu

SEQ ID NO: 21348 - RNA, 20 nt, Artificial Sequence
  targeting sequence with TTCN PAM
ccucacccacuguuuucuua

SEQ ID NO: 21349 - RNA, 20 nt, Artificial Sequence
  targeting sequence with TTCN PAM
ccuucuccucacccacuguu

SEQ ID NO: 21350 - RNA, 20 nt, Artificial Sequence
  targeting sequence with TTCN PAM
uuaggaguaggagaauuaau

SEQ ID NO: 21351 - RNA, 20 nt, Artificial Sequence
  targeting sequence with TTCN PAM
ccuacuccuaaagaauuaau

SEQ ID NO: 21352 - RNA, 20 nt, Artificial Sequence
  targeting sequence with TTCN PAM
gugcuuuuuguuggucacuu

SEQ ID NO: 21353 - RNA, 20 nt, Artificial Sequence
  targeting sequence with TTCN PAM
gcaagugaccaacaaaaagc

SEQ ID NO: 21354 - RNA, 20 nt, Artificial Sequence
  targeting sequence with TTCN PAM
guuguagccacugaaaucuu

SEQ ID NO: 21355 - RNA, 20 nt, Artificial Sequence
  targeting sequence with TTCN PAM
guggcuacaacugaagauuu

SEQ ID NO: 21356 - RNA, 20 nt, Artificial Sequence
  targeting sequence with TTCN PAM
caggcacaaugaugcuauac

SEQ ID NO: 21357 - RNA, 20 nt, Artificial Sequence
  targeting sequence with TTCN PAM
uccagugacuuugguacguu

SEQ ID NO: 21358 - RNA, 20 nt, Artificial Sequence
  targeting sequence with TTCN PAM
gauuccugauguccuguccu

SEQ ID NO: 21359 - RNA, 20 nt, Artificial Sequence
  targeting sequence with TTCN PAM
ugauguccuguccuggaaua

SEQ ID NO: 21360 - RNA, 20 nt, Artificial Sequence
  targeting sequence with TTCN PAM
aggacaggacaucaggaauc

SEQ ID NO: 21361 - RNA, 20 nt, Artificial Sequence
  targeting sequence with TTCN PAM
guuauuccaggacaggacau

SEQ ID NO: 21362 - RNA, 20 nt, Artificial Sequence
  targeting sequence with TTCN PAM
gaauauggugauuuuauccu

SEQ ID NO: 21363 - RNA, 20 nt, Artificial Sequence
  targeting sequence with TTCN PAM
gaaugcauuuuagcauuuuu

SEQ ID NO: 21364 - RNA, 20 nt, Artificial Sequence
  targeting sequence with TTCN PAM
cuaccuucaauggcugaggg

SEQ ID NO: 21365 - RNA, 20 nt, Artificial Sequence
  targeting sequence with TTCN PAM
auggcugaggggaggcugac

SEQ ID NO: 21366 - RNA, 20 nt, Artificial Sequence
  targeting sequence with TTCN PAM
uuaaauuguguggaaaccaa

SEQ ID NO: 21367 - RNA, 20 nt, Artificial Sequence
  targeting sequence with TTCN PAM
acacaauuuaaagaauaacu

SEQ ID NO: 21368 - RNA, 20 nt, Artificial Sequence
  targeting sequence with TTCN PAM
cugucuugguuuccacacaa

SEQ ID NO: 21369 - RNA, 20 nt, Artificial Sequence
  targeting sequence with TTCN PAM
uguagucucugaugucuuac

SEQ ID NO: 21370 - RNA, 20 nt, Artificial Sequence
  targeting sequence with TTCN PAM
uuugcuggggcccuuccugu

SEQ ID NO: 21371 - RNA, 20 nt, Artificial Sequence
  targeting sequence with TTCN PAM
caaaggcagcaacaccaagu

SEQ ID NO: 21372 - RNA, 20 nt, Artificial Sequence
  targeting sequence with TTCN PAM
cuugguguugcugccucugg

SEQ ID NO: 21373 - RNA, 20 nt, Artificial Sequence
  targeting sequence with TTCN PAM
cagaggcagcaacaccaagg

SEQ ID NO: 21374 - RNA, 20 nt, Artificial Sequence
  targeting sequence with TTCN PAM
cugacucacccuggcagaga

SEQ ID NO: 21375 - RNA, 20 nt, Artificial Sequence
  targeting sequence with TTCN PAM
cauaaacauagauguggguc

SEQ ID NO: 21376 - RNA, 20 nt, Artificial Sequence
  targeting sequence with TTCN PAM
ucacuguugcgguucuacuu

SEQ ID NO: 21377 - RNA, 20 nt, Artificial Sequence
  targeting sequence with TTCN PAM
cuguugcgguucuacuucuu

SEQ ID NO: 21378 - RNA, 20 nt, Artificial Sequence
  targeting sequence with TTCN PAM
acuucuugugcaauuugucg

SEQ ID NO: 21379 - RNA, 20 nt, Artificial Sequence
  targeting sequence with TTCN PAM
ugugcaauuugucgucauua

SEQ ID NO: 21380 - RNA, 20 nt, Artificial Sequence
  targeting sequence with TTCN PAM
gccccucagggaggacagcu

SEQ ID NO: 21381 - RNA, 20 nt, Artificial Sequence
  targeting sequence with TTCN PAM
uccuggccacggucccgugc

SEQ ID NO: 21382 - RNA, 20 nt, Artificial Sequence
  targeting sequence with TTCN PAM
ucccuccacagacauuuuac

SEQ ID NO: 21383 - RNA, 20 nt, Artificial Sequence
  targeting sequence with TTCN PAM
cucccuuccucccuccacag

SEQ ID NO: 21384 - RNA, 20 nt, Artificial Sequence
  targeting sequence with TTCN PAM
auuaaugguugauucuguuu

SEQ ID NO: 21385 - RNA, 20 nt, Artificial Sequence
  targeting sequence with TTCN PAM
guuuucagcucuaucagucu

SEQ ID NO: 21386 - RNA, 20 nt, Artificial Sequence
  targeting sequence with TTCN PAM
gcucuaucagucuguguucg

SEQ ID NO: 21387 - RNA, 20 nt, Artificial Sequence
  targeting sequence with TTCN PAM
uugcuaguggauacaaugaa

SEQ ID NO: 21388 - RNA, 20 nt, Artificial Sequence
  targeting sequence with TTCN PAM
uuguauccacuagcaacgaa

SEQ ID NO: 21389 - RNA, 20 nt, Artificial Sequence
  targeting sequence with TTCN PAM
aguucccuuaucuaaaagga

SEQ ID NO: 21390 - RNA, 20 nt, Artificial Sequence
  targeting sequence with TTCN PAM
cuuaucuaaaaggagcaugc

SEQ ID NO: 21391 - RNA, 20 nt, Artificial Sequence
  targeting sequence with TTCN PAM
gguucugagguucaaaagag

SEQ ID NO: 21392 - RNA, 20 nt, Artificial Sequence
  targeting sequence with TTCN PAM
gagguucaaaagagagaaug

SEQ ID NO: 21393 - RNA, 20 nt, Artificial Sequence
  targeting sequence with TTCN PAM
aaagagagaauggaauugaa

SEQ ID NO: 21394 - RNA, 20 nt, Artificial Sequence
  targeting sequence with TTCN PAM
cucuuuugaaccucagaacc

SEQ ID NO: 21395 - RNA, 20 nt, Artificial Sequence
  targeting sequence with TTCN PAM
auucucucuuuugaaccuca

SEQ ID NO: 21396 - RNA, 20 nt, Artificial Sequence
  targeting sequence with TTCN PAM
auuccauucucucuuuugaa

SEQ ID NO: 21397 - RNA, 20 nt, Artificial Sequence
  targeting sequence with TTCN PAM
ccauguauuuauacaauugg

SEQ ID NO: 21398 - RNA, 20 nt, Artificial Sequence
  targeting sequence with TTCN PAM
ucaugugaagcacuggucug

SEQ ID NO: 21399 - RNA, 20 nt, Artificial Sequence
  targeting sequence with TTCN PAM
ugugaagcacuggucugugu

SEQ ID NO: 21400 - RNA, 20 nt, Artificial Sequence
  targeting sequence with TTCN PAM
caugaagaaaaugcuauaaa

SEQ ID NO: 21401 - RNA, 20 nt, Artificial Sequence
  targeting sequence with TTCN PAM
aguguaagcacacagaccag

SEQ ID NO: 21402 - RNA, 20 nt, Artificial Sequence
  targeting sequence with TTCN PAM
auuuugccuuuuuaauauuc

SEQ ID NO: 21403 - RNA, 20 nt, Artificial Sequence
  targeting sequence with TTCN PAM
ccuaagaccacaagcuccuu

SEQ ID NO: 21404 - RNA, 20 nt, Artificial Sequence
  targeting sequence with TTCN PAM
auaaauacuaguacuuaaua

SEQ ID NO: 21405 - RNA, 20 nt, Artificial Sequence
  targeting sequence with TTCN PAM
aaggauuagaaaugaauuuc

SEQ ID NO: 21406 - RNA, 20 nt, Artificial Sequence
  targeting sequence with TTCN PAM
aauccuuagaacagugccua

SEQ ID NO: 21407 - RNA, 20 nt, Artificial Sequence
  targeting sequence with TTCN PAM
uuucuaauccuuagaacagu

SEQ ID NO: 21408 - RNA, 20 nt, Artificial Sequence
  targeting sequence with TTCN PAM
auuugagcuuuaugacagcc

SEQ ID NO: 21409 - RNA, 20 nt, Artificial Sequence
  targeting sequence with TTCN PAM
cauucccacccuacugauga

SEQ ID NO: 21410 - RNA, 20 nt, Artificial Sequence
  targeting sequence with TTCN PAM
cacccuacugaugaaaaaga

SEQ ID NO: 21411 - RNA, 20 nt, Artificial Sequence
  targeting sequence with TTCN PAM
ucaguagggugggaaugaga

SEQ ID NO: 21412 - RNA, 20 nt, Artificial Sequence
  targeting sequence with TTCN PAM
uccacuuacuagcuaaggga

SEQ ID NO: 21413 - RNA, 20 nt, Artificial Sequence
  targeting sequence with TTCN PAM
gcagugcuuagcagagcagg

SEQ ID NO: 21414 - RNA, 20 nt, Artificial Sequence
  targeting sequence with TTCN PAM
uccugggccuccuucagcag

SEQ ID NO: 21415 - RNA, 20 nt, Artificial Sequence
  targeting sequence with TTCN PAM
uccagcuuggggcuccaggc

SEQ ID NO: 21416 - RNA, 20 nt, Artificial Sequence
  targeting sequence with TTCN PAM
agcuuggggcuccaggcagg

SEQ ID NO: 21417 - RNA, 20 nt, Artificial Sequence
  targeting sequence with TTCN PAM
acuaagccugccuggagccc

SEQ ID NO: 21418 - RNA, 20 nt, Artificial Sequence
  targeting sequence with TTCN PAM
uccaaacauuuugacgugug

SEQ ID NO: 21419 - RNA, 20 nt, Artificial Sequence
  targeting sequence with TTCN PAM
ggaccaggggaaaggcaaaa

SEQ ID NO: 21420 - RNA, 20 nt, Artificial Sequence
  targeting sequence with TTCN PAM
ccugguccagaacgcuuccu

SEQ ID NO: 21421 - RNA, 20 nt, Artificial Sequence
  targeting sequence with TTCN PAM
ugauuguacuucgcaacuug

SEQ ID NO: 21422 - RNA, 20 nt, Artificial Sequence
  targeting sequence with TTCN PAM
caacuuggcaaauagaagaa

SEQ ID NO: 21423 - RNA, 20 nt, Artificial Sequence
  targeting sequence with TTCN PAM
auuugccaaguugcgaagua

SEQ ID NO: 21424 - RNA, 20 nt, Artificial Sequence
  targeting sequence with TTCN PAM
ucuauuugccaaguugcgaa

SEQ ID NO: 21425 - RNA, 20 nt, Artificial Sequence
  targeting sequence with TTCN PAM
uaggucucaaucacaacaca

SEQ ID NO: 21426 - RNA, 20 nt, Artificial Sequence
  targeting sequence with TTCN PAM
uucauaggucucaaucacaa

SEQ ID NO: 21427 - RNA, 20 nt, Artificial Sequence
  targeting sequence with TTCN PAM
gaaagcaucauuguuauuuu

SEQ ID NO: 21428 - RNA, 20 nt, Artificial Sequence
  targeting sequence with TTCN PAM
gaaaaucuaguuuucuuuca

SEQ ID NO: 21429 - RNA, 20 nt, Artificial Sequence
  targeting sequence with TTCN PAM
uuguuuauaacuuugacacu

SEQ ID NO: 21430 - RNA, 20 nt, Artificial Sequence
  targeting sequence with TTCN PAM
uugagagucaaaucccugaa

SEQ ID NO: 21431 - RNA, 20 nt, Artificial Sequence
  targeting sequence with TTCN PAM
gggauuugacucucaaagaa

SEQ ID NO: 21432 - RNA, 20 nt, Artificial Sequence
  targeting sequence with TTCN PAM
agccaacuuuucagggauuu

SEQ ID NO: 21433 - RNA, 20 nt, Artificial Sequence
  targeting sequence with TTCN PAM
ucugaaagaaugauagauuc

SEQ ID NO: 21434 - RNA, 20 nt, Artificial Sequence
  targeting sequence with TTCN PAM
gaaagaaugauagauucaua

SEQ ID NO: 21435 - RNA, 20 nt, Artificial Sequence
  targeting sequence with TTCN PAM
gaagaaaaauaaaauagauu

SEQ ID NO: 21436 - RNA, 20 nt, Artificial Sequence
  targeting sequence with TTCN PAM
uucagaagaaaaauaaaaua

SEQ ID NO: 21437 - RNA, 20 nt, Artificial Sequence
  targeting sequence with TTCN PAM
uaguaaguuacaaagauggu

SEQ ID NO: 21438 - RNA, 20 nt, Artificial Sequence
  targeting sequence with TTCN PAM
ugguaccaucuuuguaacuu

SEQ ID NO: 21439 - RNA, 20 nt, Artificial Sequence
  targeting sequence with TTCN PAM
uccaguuucccccaguggau

SEQ ID NO: 21440 - RNA, 20 nt, Artificial Sequence
  targeting sequence with TTCN PAM
cccaguggauccaucuuaug

SEQ ID NO: 21441 - RNA, 20 nt, Artificial Sequence
  targeting sequence with TTCN PAM
uggucuugauauuguauaau

SEQ ID NO: 21442 - RNA, 20 nt, Artificial Sequence
  targeting sequence with TTCN PAM
guuguuuuaucgcaugugua

SEQ ID NO: 21443 - RNA, 20 nt, Artificial Sequence
  targeting sequence with TTCN PAM
gugucacgcugauggcaauc

SEQ ID NO: 21444 - RNA, 20 nt, Artificial Sequence
  targeting sequence with TTCN PAM
ccauuucuauaauuuuguca

SEQ ID NO: 21445 - RNA, 20 nt, Artificial Sequence
  targeting sequence with TTCN PAM
auaauuuugucauucaagaa

SEQ ID NO: 21446 - RNA, 20 nt, Artificial Sequence
  targeting sequence with TTCN PAM
agaauguuauauaaauggaa

SEQ ID NO: 21447 - RNA, 20 nt, Artificial Sequence
  targeting sequence with TTCN PAM
ugaaugacaaaauuauagaa

SEQ ID NO: 21448 - RNA, 20 nt, Artificial Sequence
  targeting sequence with TTCN PAM
auuuauauaacauucuugaa

SEQ ID NO: 21449 - RNA, 20 nt, Artificial Sequence
  targeting sequence with TTCN PAM
uucagcauaaaauccuggag

SEQ ID NO: 21450 - RNA, 20 nt, Artificial Sequence
  targeting sequence with TTCN PAM
gcauaaaauccuggagaucc

SEQ ID NO: 21451 - RNA, 20 nt, Artificial Sequence
  targeting sequence with TTCN PAM
auuauuuguuccuuuuuauu

SEQ ID NO: 21452 - RNA, 20 nt, Artificial Sequence
  targeting sequence with TTCN PAM
uuuuuauugcuggguaguau

SEQ ID NO: 21453 - RNA, 20 nt, Artificial Sequence
  targeting sequence with TTCN PAM
aaccaauccaucuucuuuua

SEQ ID NO: 21454 - RNA, 20 nt, Artificial Sequence
  targeting sequence with TTCN PAM
uuuauauuauugugcauuga

SEQ ID NO: 21455 - RNA, 20 nt, Artificial Sequence
  targeting sequence with TTCN PAM
augcacaauaauauaaaaga

SEQ ID NO: 21456 - RNA, 20 nt, Artificial Sequence
  targeting sequence with TTCN PAM
ggagaccacaacccuucaau

SEQ ID NO: 21457 - RNA, 20 nt, Artificial Sequence
  targeting sequence with TTCN PAM
guucaggagaccacaacccu

SEQ ID NO: 21458 - RNA, 20 nt, Artificial Sequence
  targeting sequence with TTCN PAM
uucaucuuccacacagacuc

SEQ ID NO: 21459 - RNA, 20 nt, Artificial Sequence
  targeting sequence with TTCN PAM
ucuuccacacagacucucaa

SEQ ID NO: 21460 - RNA, 20 nt, Artificial Sequence
  targeting sequence with TTCN PAM
acacagacucucaaaaucca

SEQ ID NO: 21461 - RNA, 20 nt, Artificial Sequence
  targeting sequence with TTCN PAM
ugcagcagagaaggucuugu

SEQ ID NO: 21462 - RNA, 20 nt, Artificial Sequence
  targeting sequence with TTCN PAM
cugcugcaugaaauaauugg

SEQ ID NO: 21463 - RNA, 20 nt, Artificial Sequence
  targeting sequence with TTCN PAM
uuuuuucuucuuucuucguc

SEQ ID NO: 21464 - RNA, 20 nt, Artificial Sequence
  targeting sequence with TTCN PAM
ucuuucuucgucuccucgau

SEQ ID NO: 21465 - RNA, 20 nt, Artificial Sequence
  targeting sequence with TTCN PAM
uucuucgucuccucgauggg

SEQ ID NO: 21466 - RNA, 20 nt, Artificial Sequence
  targeting sequence with TTCN PAM
ucgucuccucgaugggaaag

SEQ ID NO: 21467 - RNA, 20 nt, Artificial Sequence
  targeting sequence with TTCN PAM
ucuccucgaugggaaagacu

SEQ ID NO: 21468 - RNA, 20 nt, Artificial Sequence
  targeting sequence with TTCN PAM
caucgaggagacgaagaaag

SEQ ID NO: 21469 - RNA, 20 nt, Artificial Sequence
  targeting sequence with TTCN PAM
ugaucaaaggcacaagucuu

SEQ ID NO: 21470 - RNA, 20 nt, Artificial Sequence
  targeting sequence with TTCN PAM
cuuuugcuucaugaucaaag

SEQ ID NO: 21471 - RNA, 20 nt, Artificial Sequence
  targeting sequence with TTCN PAM
ugcaguuacuuagcaacaag

SEQ ID NO: 21472 - RNA, 20 nt, Artificial Sequence
  targeting sequence with TTCN PAM
acaagccuccacucaguaua

SEQ ID NO: 21473 - RNA, 20 nt, Artificial Sequence
  targeting sequence with TTCN PAM
ccacacaugcugccuggaca

SEQ ID NO: 21474 - RNA, 20 nt, Artificial Sequence
  targeting sequence with TTCN PAM
uccccacacaugcugccugg

SEQ ID NO: 21475 - RNA, 20 nt, Artificial Sequence
  targeting sequence with TTCN PAM
cucccacacuuugaugcuag

SEQ ID NO: 21476 - RNA, 20 nt, Artificial Sequence
  targeting sequence with TTCN PAM
ggucuagcaucaaagugugg

SEQ ID NO: 21477 - RNA, 20 nt, Artificial Sequence
  targeting sequence with TTCN PAM
aauucaggucuagcaucaaa

SEQ ID NO: 21478 - RNA, 20 nt, Artificial Sequence
  targeting sequence with TTCN PAM
ggauucuaauucaggucuag

SEQ ID NO: 21479 - RNA, 20 nt, Artificial Sequence
  targeting sequence with TTCN PAM
ugaggucacauggccuguca

SEQ ID NO: 21480 - RNA, 20 nt, Artificial Sequence
  targeting sequence with TTCN PAM
gagcuggagcuuuacguucc

SEQ ID NO: 21481 - RNA, 20 nt, Artificial Sequence
  targeting sequence with TTCN PAM
ucaucugacagauagggaua

SEQ ID NO: 21482 - RNA, 20 nt, Artificial Sequence
  targeting sequence with TTCN PAM
caacaaucucgucaagucag

SEQ ID NO: 21483 - RNA, 20 nt, Artificial Sequence
  targeting sequence with TTCN PAM
ugcuguucagcuucuaggag

SEQ ID NO: 21484 - RNA, 20 nt, Artificial Sequence
  targeting sequence with TTCN PAM
gcuucuaggaguauaucccu

SEQ ID NO: 21485 - RNA, 20 nt, Artificial Sequence
  targeting sequence with TTCN PAM
aggaguauaucccuuccguu

SEQ ID NO: 21486 - RNA, 20 nt, Artificial Sequence
  targeting sequence with TTCN PAM
guucagcaucuguugagcac

SEQ ID NO: 21487 - RNA, 20 nt, Artificial Sequence
  targeting sequence with TTCN PAM
gcaucuguugagcaccuucu

SEQ ID NO: 21488 - RNA, 20 nt, Artificial Sequence
  targeting sequence with TTCN PAM
acaaagcaagcacuguucua

SEQ ID NO: 21489 - RNA, 20 nt, Artificial Sequence
  targeting sequence with TTCN PAM
agggguuggaagacaccaag

SEQ ID NO: 21490 - RNA, 20 nt, Artificial Sequence
  targeting sequence with TTCN PAM
aaccccuagaacagugcuug

SEQ ID NO: 21491 - RNA, 20 nt, Artificial Sequence
  targeting sequence with TTCN PAM
uaaggugcucuuuaaguggg

SEQ ID NO: 21492 - RNA, 20 nt, Artificial Sequence
  targeting sequence with TTCN PAM
cacucuccaucucaaucccc

SEQ ID NO: 21493 - RNA, 20 nt, Artificial Sequence
  targeting sequence with TTCN PAM
gagcucccccagcccucugu

SEQ ID NO: 21494 - RNA, 20 nt, Artificial Sequence
  targeting sequence with TTCN PAM
augggaucaucagcauacgg

SEQ ID NO: 21495 - RNA, 20 nt, Artificial Sequence
  targeting sequence with TTCN PAM
guaugcugaugaucccauug

SEQ ID NO: 21496 - RNA, 20 nt, Artificial Sequence
  targeting sequence with TTCN PAM
ccucgccauuuuuguuccgu

SEQ ID NO: 21497 - RNA, 20 nt, Artificial Sequence
  targeting sequence with TTCN PAM
agcagauggaccauauuggc

SEQ ID NO: 21498 - RNA, 20 nt, Artificial Sequence
  targeting sequence with TTCN PAM
agguacucuuaaaguugucc

SEQ ID NO: 21499 - RNA, 20 nt, Artificial Sequence
  targeting sequence with TTCN PAM
agaacaaacaccaucaugaa

SEQ ID NO: 21500 - RNA, 20 nt, Artificial Sequence
  targeting sequence with TTCN PAM
agaaggaggacaacuuuaag

SEQ ID NO: 21501 - RNA, 20 nt, Artificial Sequence
  targeting sequence with TTCN PAM
cagguagcgggacuauuaaa

SEQ ID NO: 21502 - RNA, 20 nt, Artificial Sequence
  targeting sequence with TTCN PAM
auacauucucagguagcggg

SEQ ID NO: 21503 - RNA, 20 nt, Artificial Sequence
  targeting sequence with TTCN PAM
uaaacucaacuuuugaggag

SEQ ID NO: 21504 - RNA, 20 nt, Artificial Sequence
  targeting sequence with TTCN PAM
uuccuaaacucaacuuuuga

SEQ ID NO: 21505 - RNA, 20 nt, Artificial Sequence
  targeting sequence with TTCN PAM
uaaggaaaugguccugcugc

SEQ ID NO: 21506 - RNA, 20 nt, Artificial Sequence
  targeting sequence with TTCN PAM
uuuuuuaguucuucccucca

SEQ ID NO: 21507 - RNA, 20 nt, Artificial Sequence
  targeting sequence with TTCN PAM
ucccuccaaguuugggcaga

SEQ ID NO: 21508 - RNA, 20 nt, Artificial Sequence
  targeting sequence with TTCN PAM
cuccaaguuugggcagaaua

SEQ ID NO: 21509 - RNA, 20 nt, Artificial Sequence
  targeting sequence with TTCN PAM
gcccaaacuuggagggaaga

SEQ ID NO: 21510 - RNA, 20 nt, Artificial Sequence
  targeting sequence with TTCN PAM
ugagccuuuuuuugcccuug

SEQ ID NO: 21511 - RNA, 20 nt, Artificial Sequence
  targeting sequence with TTCN PAM
gacaagggcaaaaaaaggcu

SEQ ID NO: 21512 - RNA, 20 nt, Artificial Sequence
  targeting sequence with TTCN PAM
uaaauuuuauacacacuuug

SEQ ID NO: 21513 - RNA, 20 nt, Artificial Sequence
  targeting sequence with TTCN PAM
auguccaugugacuuugaga

SEQ ID NO: 21514 - RNA, 20 nt, Artificial Sequence
  targeting sequence with TTCN PAM
uuuacccucagaggacucug

SEQ ID NO: 21515 - RNA, 20 nt, Artificial Sequence
  targeting sequence with TTCN PAM
aaaucaaguaggcaaccauc

SEQ ID NO: 21516 - RNA, 20 nt, Artificial Sequence
  targeting sequence with TTCN PAM
aaacaaccuucuaaaucaag

SEQ ID NO: 21517 - RNA, 20 nt, Artificial Sequence
  targeting sequence with TTCN PAM
uccugaauaauuuuuuuugg

SEQ ID NO: 21518 - RNA, 20 nt, Artificial Sequence
  targeting sequence with TTCN PAM
ugaauaauuuuuuuuggccc

SEQ ID NO: 21519 - RNA, 20 nt, Artificial Sequence
  targeting sequence with TTCN PAM
ggaagaagcauaauaaccuu

SEQ ID NO: 21520 - RNA, 20 nt, Artificial Sequence
  targeting sequence with TTCN PAM
ugcuguuugauuuguggcug

SEQ ID NO: 21521 - RNA, 20 nt, Artificial Sequence
  targeting sequence with TTCN PAM
ugagaagcaggaggcccugu

SEQ ID NO: 21522 - RNA, 20 nt, Artificial Sequence
  targeting sequence with TTCN PAM
caugaauuaaaaaugguagc

SEQ ID NO: 21523 - RNA, 20 nt, Artificial Sequence
  targeting sequence with TTCN PAM
gaggcuccuuuuauuuuuua

SEQ ID NO: 21524 - RNA, 20 nt, Artificial Sequence
  targeting sequence with TTCN PAM
uuuuuuuuuuuuuuuuuuuu

SEQ ID NO: 21525 - RNA, 20 nt, Artificial Sequence
  targeting sequence with TTCN PAM
agcaauccucucaccucagc

SEQ ID NO: 21526 - RNA, 20 nt, Artificial Sequence
  targeting sequence with TTCN PAM
ccauguuggccaggcugguc

SEQ ID NO: 21527 - RNA, 20 nt, Artificial Sequence
  targeting sequence with TTCN PAM
agaccagccuggccaacaug

SEQ ID NO: 21528 - RNA, 20 nt, Artificial Sequence
  targeting sequence with TTCN PAM
cuugccucggccuccugaag

SEQ ID NO: 21529 - RNA, 20 nt, Artificial Sequence
  targeting sequence with TTCN PAM
ggaggccgaggcaagugaau

SEQ ID NO: 21530 - RNA, 20 nt, Artificial Sequence
  targeting sequence with TTCN PAM
aggcaauguaauuuugaaca

SEQ ID NO: 21531 - RNA, 20 nt, Artificial Sequence
  targeting sequence with TTCN PAM
aaauuacauugccuagaacu

SEQ ID NO: 21532 - RNA, 20 nt, Artificial Sequence
  targeting sequence with TTCN PAM
ggaugaacagagagaaugag

SEQ ID NO: 21533 - RNA, 20 nt, Artificial Sequence
  targeting sequence with TTCN PAM
uccagaaacucucccaucgg

SEQ ID NO: 21534 - RNA, 20 nt, Artificial Sequence
  targeting sequence with TTCN PAM
cucuguucauccagaaacuc

SEQ ID NO: 21535 - RNA, 20 nt, Artificial Sequence
  targeting sequence with TTCN PAM
ggaaaucccuuccacucuga

SEQ ID NO: 21536 - RNA, 20 nt, Artificial Sequence
  targeting sequence with TTCN PAM
ugaauauaucuguugacaau

SEQ ID NO: 21537 - RNA, 20 nt, Artificial Sequence
  targeting sequence with TTCN PAM
acucugaagucagcagugua

SEQ ID NO: 21538 - RNA, 20 nt, Artificial Sequence
  targeting sequence with TTCN PAM
gaguggaagggauuuccuga

SEQ ID NO: 21539 - RNA, 20 nt, Artificial Sequence
  targeting sequence with TTCN PAM
uccucugccucacuacccug

SEQ ID NO: 21540 - RNA, 20 nt, Artificial Sequence
  targeting sequence with TTCN PAM
uccuccucugccucacuacc

SEQ ID NO: 21541 - RNA, 20 nt, Artificial Sequence
  targeting sequence with TTCN PAM
ucugguucuuccuccucugc

SEQ ID NO: 21542 - RNA, 20 nt, Artificial Sequence
  targeting sequence with TTCN PAM
cacucacugggacacacuca

SEQ ID NO: 21543 - RNA, 20 nt, Artificial Sequence
  targeting sequence with TTCN PAM
gguaagggcccaggccccac

SEQ ID NO: 21544 - RNA, 20 nt, Artificial Sequence
  targeting sequence with TTCN PAM
cacaggaucacuuuauaccc

SEQ ID NO: 21545 - RNA, 20 nt, Artificial Sequence
  targeting sequence with TTCN PAM
uauaguuucucacaggauca

SEQ ID NO: 21546 - RNA, 20 nt, Artificial Sequence
  targeting sequence with TTCN PAM
guauuuccuauaguuucuca

SEQ ID NO: 21547 - RNA, 20 nt, Artificial Sequence
  targeting sequence with TTCN PAM
ccuuuagucuuuucaguauu

SEQ ID NO: 21548 - RNA, 20 nt, Artificial Sequence
  targeting sequence with TTCN PAM
acuuuucugauaaaacccca

SEQ ID NO: 21549 - RNA, 20 nt, Artificial Sequence
  targeting sequence with TTCN PAM
gauaaaaccccauccccuga

SEQ ID NO: 21550 - RNA, 20 nt, Artificial Sequence
  targeting sequence with TTCN PAM
ucucuucaguugagauugcc

SEQ ID NO: 21551 - RNA, 20 nt, Artificial Sequence
  targeting sequence with TTCN PAM
cuucaguugagauugccugu

SEQ ID NO: 21552 - RNA, 20 nt, Artificial Sequence
  targeting sequence with TTCN PAM
guugagauugccuguaggga

SEQ ID NO: 21553 - RNA, 20 nt, Artificial Sequence
  targeting sequence with TTCN PAM
cuacaggcaaucucaacuga

SEQ ID NO: 21554 - RNA, 20 nt, Artificial Sequence
  targeting sequence with TTCN PAM
ccacucuggccugcccaugu

SEQ ID NO: 21555 - RNA, 20 nt, Artificial Sequence
  targeting sequence with TTCN PAM
aaacuguuuuacauaguacc

SEQ ID NO: 21556 - RNA, 20 nt, Artificial Sequence
  targeting sequence with TTCN PAM
uuggaagaaucccacccuga

SEQ ID NO: 21557 - RNA, 20 nt, Artificial Sequence
  targeting sequence with TTCN PAM
aaggaaacucagguacuaug

SEQ ID NO: 21558 - RNA, 20 nt, Artificial Sequence
  targeting sequence with TTCN PAM
uccaaggaaacucagguacu

SEQ ID NO: 21559 - RNA, 20 nt, Artificial Sequence
  targeting sequence with TTCN PAM
cagcccccaugaccucaggg

SEQ ID NO: 21560 - RNA, 20 nt, Artificial Sequence
  targeting sequence with TTCN PAM
uccuuuacugguccccacuu

SEQ ID NO: 21561 - RNA, 20 nt, Artificial Sequence
  targeting sequence with TTCN PAM
acaugaguuuuuguuucaua

SEQ ID NO: 21562 - RNA, 20 nt, Artificial Sequence
  targeting sequence with TTCN PAM
uaaagaauccuacugcccca

SEQ ID NO: 21563 - RNA, 20 nt, Artificial Sequence
  targeting sequence with TTCN PAM
uuaugaaacaaaaacucaug

SEQ ID NO: 21564 - RNA, 20 nt, Artificial Sequence
  targeting sequence with TTCN PAM
acccccuuuuaccuccuggg

SEQ ID NO: 21565 - RNA, 20 nt, Artificial Sequence
  targeting sequence with TTCN PAM
cuuaguuuuggguuagugcc

SEQ ID NO: 21566 - RNA, 20 nt, Artificial Sequence
  targeting sequence with TTCN PAM
gaucccagugucuuguggua

SEQ ID NO: 21567 - RNA, 20 nt, Artificial Sequence
  targeting sequence with TTCN PAM
agcuuuucugaucccagugu

SEQ ID NO: 21568 - RNA, 20 nt, Artificial Sequence
  targeting sequence with TTCN PAM
uagcccuugaggcugggucu

SEQ ID NO: 21569 - RNA, 20 nt, Artificial Sequence
  targeting sequence with TTCN PAM
uuuuuuuuuuugugacagag

SEQ ID NO: 21570 - RNA, 20 nt, Artificial Sequence
  targeting sequence with TTCN PAM
gccucccggguucuaagcga

SEQ ID NO: 21571 - RNA, 20 nt, Artificial Sequence
  targeting sequence with TTCN PAM
aagcgauucuugugccucag

SEQ ID NO: 21572 - RNA, 20 nt, Artificial Sequence
  targeting sequence with TTCN PAM
ugugccucagccucuggaau

SEQ ID NO: 21573 - RNA, 20 nt, Artificial Sequence
  targeting sequence with TTCN PAM
agaggcugaggcacaagaau

SEQ ID NO: 21574 - RNA, 20 nt, Artificial Sequence
  targeting sequence with TTCN PAM
gcguggugucgcgugucugu

SEQ ID NO: 21575 - RNA, 20 nt, Artificial Sequence
  targeting sequence with TTCN PAM
guaaagauaggguuucccca

SEQ ID NO: 21576 - RNA, 20 nt, Artificial Sequence
  targeting sequence with TTCN PAM
ccauguuggccaggcugguc

SEQ ID NO: 21577 - RNA, 20 nt, Artificial Sequence
  targeting sequence with TTCN PAM
agaccagccuggccaacaug

SEQ ID NO: 21578 - RNA, 20 nt, Artificial Sequence
  targeting sequence with TTCN PAM
agcacuuugggagguugagg

SEQ ID NO: 21579 - RNA, 20 nt, Artificial Sequence
  targeting sequence with TTCN PAM
cuugaacuagauucccaggu

SEQ ID NO: 21580 - RNA, 20 nt, Artificial Sequence
  targeting sequence with TTCN PAM
agagaaaagcggcagcccgu

SEQ ID NO: 21581 - RNA, 20 nt, Artificial Sequence
  targeting sequence with TTCN PAM
cagguagcuugcucuccagc

SEQ ID NO: 21582 - RNA, 20 nt, Artificial Sequence
  targeting sequence with TTCN PAM
ccugugugcugguccuacag

SEQ ID NO: 21583 - RNA, 20 nt, Artificial Sequence
  targeting sequence with TTCN PAM
caguuucaaagacaguuguu

SEQ ID NO: 21584 - RNA, 20 nt, Artificial Sequence
  targeting sequence with TTCN PAM
aagacaguuguuuguuuuca

SEQ ID NO: 21585 - RNA, 20 nt, Artificial Sequence
  targeting sequence with TTCN PAM
gagcccauugcucuuuuuug

SEQ ID NO: 21586 - RNA, 20 nt, Artificial Sequence
  targeting sequence with TTCN PAM
aaaaagagcaaugggcucug

SEQ ID NO: 21587 - RNA, 20 nt, Artificial Sequence
  targeting sequence with TTCN PAM
gucagaaaccauuucaccug

SEQ ID NO: 21588 - RNA, 20 nt, Artificial Sequence
  targeting sequence with TTCN PAM
gacugaaucuaauuuucaaa

SEQ ID NO: 21589 - RNA, 20 nt, Artificial Sequence
  targeting sequence with TTCN PAM
ccugugcaaggacccccgcc

SEQ ID NO: 21590 - RNA, 20 nt, Artificial Sequence
  targeting sequence with TTCN PAM
ccugcaggcggggguccuug

SEQ ID NO: 21591 - RNA, 20 nt, Artificial Sequence
  targeting sequence with TTCN PAM
uucuucaggaagagcaagca

SEQ ID NO: 21592 - RNA, 20 nt, Artificial Sequence
  targeting sequence with TTCN PAM
ucaggaagagcaagcaaguu

SEQ ID NO: 21593 - RNA, 20 nt, Artificial Sequence
  targeting sequence with TTCN PAM
ggaagagcaagcaaguuucc

SEQ ID NO: 21594 - RNA, 20 nt, Artificial Sequence
  targeting sequence with TTCN PAM
ugaagaaagaaaauuaacac

SEQ ID NO: 21595 - RNA, 20 nt, Artificial Sequence
  targeting sequence with TTCN PAM
cuucuauuaaaaaaugucuu

SEQ ID NO: 21596 - RNA, 20 nt, Artificial Sequence
  targeting sequence with TTCN PAM
auuaaaaaaugucuuugugc

SEQ ID NO: 21597 - RNA, 20 nt, Artificial Sequence
  targeting sequence with TTCN PAM
cugccaucuccccacauuuu

SEQ ID NO: 21598 - RNA, 20 nt, Artificial Sequence
  targeting sequence with TTCN PAM
aguauguaagagaaaagcag

SEQ ID NO: 21599 - RNA, 20 nt, Artificial Sequence
  targeting sequence with TTCN PAM
cuuacauacuagaaaaugug

SEQ ID NO: 21600 - RNA, 20 nt, Artificial Sequence
  targeting sequence with TTCN PAM
gagcuuacuggggagcaaca

SEQ ID NO: 21601 - RNA, 20 nt, Artificial Sequence
  targeting sequence with TTCN PAM
ucagcugcagcagugucccc

SEQ ID NO: 21602 - RNA, 20 nt, Artificial Sequence
  targeting sequence with TTCN PAM
gcugcagcaguguccccagc

SEQ ID NO: 21603 - RNA, 20 nt, Artificial Sequence
  targeting sequence with TTCN PAM
cugaguccccugcuaugacc

SEQ ID NO: 21604 - RNA, 20 nt, Artificial Sequence
  targeting sequence with TTCN PAM
ugggaucugcuguuucacug

SEQ ID NO: 21605 - RNA, 20 nt, Artificial Sequence
  targeting sequence with TTCN PAM
gccuuccugggaucugcugu

SEQ ID NO: 21606 - RNA, 20 nt, Artificial Sequence
  targeting sequence with TTCN PAM
ucccguaagacugauugaug

SEQ ID NO: 21607 - RNA, 20 nt, Artificial Sequence
  targeting sequence with TTCN PAM
guaaagcuguacaacauuug

SEQ ID NO: 21608 - RNA, 20 nt, Artificial Sequence
  targeting sequence with TTCN PAM
uuguuccuguuguuuaagcc

SEQ ID NO: 21609 - RNA, 20 nt, Artificial Sequence
  targeting sequence with TTCN PAM
uguuguuuaagcccuuagag

SEQ ID NO: 21610 - RNA, 20 nt, Artificial Sequence
  targeting sequence with TTCN PAM
uaaccucuuuuaucuucugu

SEQ ID NO: 21611 - RNA, 20 nt, Artificial Sequence
  targeting sequence with TTCN PAM
guugauuagagaggaacgua

SEQ ID NO: 21612 - RNA, 20 nt, Artificial Sequence
  targeting sequence with TTCN PAM
ucucuaaucaacagaagaua

SEQ ID NO: 21613 - RNA, 20 nt, Artificial Sequence
  targeting sequence with TTCN PAM
guccccagucagccacagcc

SEQ ID NO: 21614 - RNA, 20 nt, Artificial Sequence
  targeting sequence with TTCN PAM
uucuaccagcugaguggaaa

SEQ ID NO: 21615 - RNA, 20 nt, Artificial Sequence
  targeting sequence with TTCN PAM
accagcugaguggaaaacag

SEQ ID NO: 21616 - RNA, 20 nt, Artificial Sequence
  targeting sequence with TTCN PAM
acucagcugguagaaggaaa

SEQ ID NO: 21617 - RNA, 20 nt, Artificial Sequence
  targeting sequence with TTCN PAM
uuuucugagauucuguuacu

SEQ ID NO: 21618 - RNA, 20 nt, Artificial Sequence
  targeting sequence with TTCN PAM
gagauucuguuacuauuaau

SEQ ID NO: 21619 - RNA, 20 nt, Artificial Sequence
  targeting sequence with TTCN PAM
guuacuauuaauuauacauu

SEQ ID NO: 21620 - RNA, 20 nt, Artificial Sequence
  targeting sequence with TTCN PAM
caauguccuuagccuaacuc

SEQ ID NO: 21621 - RNA, 20 nt, Artificial Sequence
  targeting sequence with TTCN PAM
ggcagaaaaaaaaauagcau

SEQ ID NO: 21622 - RNA, 20 nt, Artificial Sequence
  targeting sequence with TTCN PAM
gccugaaacaccauucccaa

SEQ ID NO: 21623 - RNA, 20 nt, Artificial Sequence
  targeting sequence with TTCN PAM
uuccugccuugauacaugcu

SEQ ID NO: 21624 - RNA, 20 nt, Artificial Sequence
  targeting sequence with TTCN PAM
uuccuuccugccuugauaca

SEQ ID NO: 21625 - RNA, 20 nt, Artificial Sequence
  targeting sequence with TTCN PAM
gagaauggugaguuguacag

SEQ ID NO: 21626 - RNA, 20 nt, Artificial Sequence
  targeting sequence with TTCN PAM
cugaacugucauauauuuuc

SEQ ID NO: 21627 - RNA, 20 nt, Artificial Sequence
  targeting sequence with TTCN PAM
ggucacaaacucugagaugc

SEQ ID NO: 21628 - RNA, 20 nt, Artificial Sequence
  targeting sequence with TTCN PAM
gcucuguuuucaggucacaa

SEQ ID NO: 21629 - RNA, 20 nt, Artificial Sequence
  targeting sequence with TTCN PAM
ucuucagcucuguuuucagg

SEQ ID NO: 21630 - RNA, 20 nt, Artificial Sequence
  targeting sequence with TTCN PAM
cacuacucagguccuuuaua

SEQ ID NO: 21631 - RNA, 20 nt, Artificial Sequence
  targeting sequence with TTCN PAM
uauucacacuacucaggucc

SEQ ID NO: 21632 - RNA, 20 nt, Artificial Sequence
  targeting sequence with TTCN PAM
aacuucuuauucacacuacu

SEQ ID NO: 21633 - RNA, 20 nt, Artificial Sequence
  targeting sequence with TTCN PAM
gaagaauaacuuguuuccau

SEQ ID NO: 21634 - RNA, 20 nt, Artificial Sequence
  targeting sequence with TTCN PAM
gaagcaagaaucugugaugc

SEQ ID NO: 21635 - RNA, 20 nt, Artificial Sequence
  targeting sequence with TTCN PAM
ucugaagcaagaaucuguga

SEQ ID NO: 21636 - RNA, 20 nt, Artificial Sequence
  targeting sequence with TTCN PAM
auggaggguggauuaaaaua

SEQ ID NO: 21637 - RNA, 20 nt, Artificial Sequence
  targeting sequence with TTCN PAM
ugccuacuaauaagucaucc

SEQ ID NO: 21638 - RNA, 20 nt, Artificial Sequence
  targeting sequence with TTCN PAM
cucuuacaugacauguuuug

SEQ ID NO: 21639 - RNA, 20 nt, Artificial Sequence
  targeting sequence with TTCN PAM
ucuaccccugccuuaccauu

SEQ ID NO: 21640 - RNA, 20 nt, Artificial Sequence
  targeting sequence with TTCN PAM
accccugccuuaccauuggu

SEQ ID NO: 21641 - RNA, 20 nt, Artificial Sequence
  targeting sequence with TTCN PAM
uuuguauucgaguaaagaaa

SEQ ID NO: 21642 - RNA, 20 nt, Artificial Sequence
  targeting sequence with TTCN PAM
uuaucugcucccuuuaucuu

SEQ ID NO: 21643 - RNA, 20 nt, Artificial Sequence
  targeting sequence with TTCN PAM
caguuucccauggcugauuu

SEQ ID NO: 21644 - RNA, 20 nt, Artificial Sequence
  targeting sequence with TTCN PAM
cauggcugauuuccuaaaac

SEQ ID NO: 21645 - RNA, 20 nt, Artificial Sequence
  targeting sequence with TTCN PAM
uaaaacucucauuuuaauua

SEQ ID NO: 21646 - RNA, 20 nt, Artificial Sequence
  targeting sequence with TTCN PAM
cuggcccucucuauucaucu

SEQ ID NO: 21647 - RNA, 20 nt, Artificial Sequence
  targeting sequence with TTCN PAM
ucugcuuaauguguguacau

SEQ ID NO: 21648 - RNA, 20 nt, Artificial Sequence
  targeting sequence with TTCN PAM
acagauacuuauuggcacac

SEQ ID NO: 21649 - RNA, 20 nt, Artificial Sequence
  targeting sequence with TTCN PAM
ugcugggugucuucccuucc

SEQ ID NO: 21650 - RNA, 20 nt, Artificial Sequence
  targeting sequence with TTCN PAM
cuucccaaucuaggaagauu

SEQ ID NO: 21651 - RNA, 20 nt, Artificial Sequence
  targeting sequence with TTCN PAM
caaucuaggaagauuuagaa

SEQ ID NO: 21652 - RNA, 20 nt, Artificial Sequence
  targeting sequence with TTCN PAM
uagauugggaagggaagaca

SEQ ID NO: 21653 - RNA, 20 nt, Artificial Sequence
  targeting sequence with TTCN PAM
aaaucuuccuagauugggaa

SEQ ID NO: 21654 - RNA, 20 nt, Artificial Sequence
  targeting sequence with TTCN PAM
auauaggaugaugaaguaaa

SEQ ID NO: 21655 - RNA, 20 nt, Artificial Sequence
  targeting sequence with TTCN PAM
ucauccuauauugaauucua

SEQ ID NO: 21656 - RNA, 20 nt, Artificial Sequence
  targeting sequence with TTCN PAM
aaugacaaaaauacacaaau

SEQ ID NO: 21657 - RNA, 20 nt, Artificial Sequence
  targeting sequence with TTCN PAM
gcaggguggaccacagacua

SEQ ID NO: 21658 - RNA, 20 nt, Artificial Sequence
  targeting sequence with TTCN PAM
ggcaccaguaugccuggguu

SEQ ID NO: 21659 - RNA, 20 nt, Artificial Sequence
  targeting sequence with TTCN PAM
aauauggauucuggcaccag

SEQ ID NO: 21660 - RNA, 20 nt, Artificial Sequence
  targeting sequence with TTCN PAM
aaaguuguauugaguaauuu

SEQ ID NO: 21661 - RNA, 20 nt, Artificial Sequence
  targeting sequence with TTCN PAM
gauuuuaaguggaaagauaa

SEQ ID NO: 21662 - RNA, 20 nt, Artificial Sequence
  targeting sequence with TTCN PAM
acuuaaaaucagaaguaggc

SEQ ID NO: 21663 - RNA, 20 nt, Artificial Sequence
  targeting sequence with TTCN PAM
uaucuuuccacuuaaaauca

SEQ ID NO: 21664 - RNA, 20 nt, Artificial Sequence
  targeting sequence with TTCN PAM
uaagcaauauuggaaugcuu

SEQ ID NO: 21665 - RNA, 20 nt, Artificial Sequence
  targeting sequence with TTCN PAM
aaaagcucagugaacaccaa

SEQ ID NO: 21666 - RNA, 20 nt, Artificial Sequence
  targeting sequence with TTCN PAM
gucuuucaccaaaugugaaa

SEQ ID NO: 21667 - RNA, 20 nt, Artificial Sequence
  targeting sequence with TTCN PAM
ccaaaugugaaaacauuuug

SEQ ID NO: 21668 - RNA, 20 nt, Artificial Sequence
  targeting sequence with TTCN PAM
cauuuggugaaagacagaac

SEQ ID NO: 21669 - RNA, 20 nt, Artificial Sequence
  targeting sequence with TTCN PAM
ugaaauauuucuucuucucc

SEQ ID NO: 21670 - RNA, 20 nt, Artificial Sequence
  targeting sequence with TTCN PAM
agaaaucauggccaaaaugu

SEQ ID NO: 21671 - RNA, 20 nt, Artificial Sequence
  targeting sequence with TTCN PAM
ucuucuccauucuuuccuuu

SEQ ID NO: 21672 - RNA, 20 nt, Artificial Sequence
  targeting sequence with TTCN PAM
ucuccauucuuuccuuuccu

SEQ ID NO: 21673 - RNA, 20 nt, Artificial Sequence
  targeting sequence with TTCN PAM
ccauucuuuccuuuccucug

SEQ ID NO: 21674 - RNA, 20 nt, Artificial Sequence
  targeting sequence with TTCN PAM
uuccuuuccucuggaacucu

SEQ ID NO: 21675 - RNA, 20 nt, Artificial Sequence
  targeting sequence with TTCN PAM
uuuccucuggaacucuaauu

SEQ ID NO: 21676 - RNA, 20 nt, Artificial Sequence
  targeting sequence with TTCN PAM
ucuggaacucuaauuacacu

SEQ ID NO: 21677 - RNA, 20 nt, Artificial Sequence
  targeting sequence with TTCN PAM
agaggaaaggaaagaaugga

SEQ ID NO: 21678 - RNA, 20 nt, Artificial Sequence
  targeting sequence with TTCN PAM
aggguuuccagauauucagu

SEQ ID NO: 21679 - RNA, 20 nt, Artificial Sequence
  targeting sequence with TTCN PAM
agauauucaguggaguuuau

SEQ ID NO: 21680 - RNA, 20 nt, Artificial Sequence
  targeting sequence with TTCN PAM
guggaguuuaugugcagaau

SEQ ID NO: 21681 - RNA, 20 nt, Artificial Sequence
  targeting sequence with TTCN PAM
gcacauaaacuccacugaau

SEQ ID NO: 21682 - RNA, 20 nt, Artificial Sequence
  targeting sequence with TTCN PAM
uuuccuguauaggaauuuca

SEQ ID NO: 21683 - RNA, 20 nt, Artificial Sequence
  targeting sequence with TTCN PAM
aauuuccuuuccuguauagg

SEQ ID NO: 21684 - RNA, 20 nt, Artificial Sequence
  targeting sequence with TTCN PAM
cuuacaccaauuuaaacugc

SEQ ID NO: 21685 - RNA, 20 nt, Artificial Sequence
  targeting sequence with TTCN PAM
aaauuggaugccuuaaacag

SEQ ID NO: 21686 - RNA, 20 nt, Artificial Sequence
  targeting sequence with TTCN PAM
cuuuaacuagauuuauaaau

SEQ ID NO: 21687 - RNA, 20 nt, Artificial Sequence
  targeting sequence with TTCN PAM
uauuuauaaaucuaguuaaa

SEQ ID NO: 21688 - RNA, 20 nt, Artificial Sequence
  targeting sequence with TTCN PAM
auuuacaaauauuuuccuau

SEQ ID NO: 21689 - RNA, 20 nt, Artificial Sequence
  targeting sequence with TTCN PAM
uaaguucaauuuacaaauau

SEQ ID NO: 21690 - RNA, 20 nt, Artificial Sequence
  targeting sequence with TTCN PAM
ccuuaaguucuuaaguucaa

SEQ ID NO: 21691 - RNA, 20 nt, Artificial Sequence
  targeting sequence with TTCN PAM
cuaaaguuauuucuuuuaua

SEQ ID NO: 21692 - RNA, 20 nt, Artificial Sequence
  targeting sequence with TTCN PAM
uuuauaaauugaauauuagu

SEQ ID NO: 21693 - RNA, 20 nt, Artificial Sequence
  targeting sequence with TTCN PAM
auuuauaaaagaaauaacuu

SEQ ID NO: 21694 - RNA, 20 nt, Artificial Sequence
  targeting sequence with TTCN PAM
caaaagacacccuuggggca

SEQ ID NO: 21695 - RNA, 20 nt, Artificial Sequence
  targeting sequence with TTCN PAM
ucugccucagccccucacca

SEQ ID NO: 21696 - RNA, 20 nt, Artificial Sequence
  targeting sequence with TTCN PAM
gggcucaauuccucugccuc

SEQ ID NO: 21697 - RNA, 20 nt, Artificial Sequence
  targeting sequence with TTCN PAM
agguugcauugaguuaugau

SEQ ID NO: 21698 - RNA, 20 nt, Artificial Sequence
  targeting sequence with TTCN PAM
agccuaagccacagagugug

SEQ ID NO: 21699 - RNA, 20 nt, Artificial Sequence
  targeting sequence with TTCN PAM
cuguggccaauaagcacaug

SEQ ID NO: 21700 - RNA, 20 nt, Artificial Sequence
  targeting sequence with TTCN PAM
ugugcuuauuggccacagag

SEQ ID NO: 21701 - RNA, 20 nt, Artificial Sequence
  targeting sequence with TTCN PAM
ugauggcuaaugauauggag

SEQ ID NO: 21702 - RNA, 20 nt, Artificial Sequence
  targeting sequence with TTCN PAM
auuugcauuuuccugauggc

SEQ ID NO: 21703 - RNA, 20 nt, Artificial Sequence
  targeting sequence with TTCN PAM
cacucacuaaaauggagaaa

SEQ ID NO: 21704 - RNA, 20 nt, Artificial Sequence
  targeting sequence with TTCN PAM
ccauuuuagugagugcgaau

SEQ ID NO: 21705 - RNA, 20 nt, Artificial Sequence
  targeting sequence with TTCN PAM
aauuucuccauuuuagugag

SEQ ID NO: 21706 - RNA, 20 nt, Artificial Sequence
  targeting sequence with TTCN PAM
cuugaaaaguguagcaguuc

SEQ ID NO: 21707 - RNA, 20 nt, Artificial Sequence
  targeting sequence with TTCN PAM
agugaaugcaccacuuuaua

SEQ ID NO: 21708 - RNA, 20 nt, Artificial Sequence
  targeting sequence with TTCN PAM
uaaaaaagguucaacguaga

SEQ ID NO: 21709 - RNA, 20 nt, Artificial Sequence
  targeting sequence with TTCN PAM
acguagaguuuaaaaauaaa

SEQ ID NO: 21710 - RNA, 20 nt, Artificial Sequence
  targeting sequence with TTCN PAM
ccuuguugucccggcuaguc

SEQ ID NO: 21711 - RNA, 20 nt, Artificial Sequence
  targeting sequence with TTCN PAM
cacacaucuguagucccagc

SEQ ID NO: 21712 - RNA, 20 nt, Artificial Sequence
  targeting sequence with TTCN PAM
cgugauccuccuaccucagc

SEQ ID NO: 21713 - RNA, 20 nt, Artificial Sequence
  targeting sequence with TTCN PAM
cagcuucacgugauccuccu

SEQ ID NO: 21714 - RNA, 20 nt, Artificial Sequence
  targeting sequence with TTCN PAM
acuccuggacucaagcgauc

SEQ ID NO: 21715 - RNA, 20 nt, Artificial Sequence
  targeting sequence with TTCN PAM
agauggggucucacucuguc

SEQ ID NO: 21716 - RNA, 20 nt, Artificial Sequence
  targeting sequence with TTCN PAM
uuuuuuaauucuuguuuauu

SEQ ID NO: 21717 - RNA, 20 nt, Artificial Sequence
  targeting sequence with TTCN PAM
cuucauuuuuuaauucuugu

SEQ ID NO: 21718 - RNA, 20 nt, Artificial Sequence
  targeting sequence with TTCN PAM
gcaacuacacccauacuacu

SEQ ID NO: 21719 - RNA, 20 nt, Artificial Sequence
  targeting sequence with TTCN PAM
guuuaaagacuguccuuuau

SEQ ID NO: 21720 - RNA, 20 nt, Artificial Sequence
  targeting sequence with TTCN PAM
cgccaacuuuagagggaguu

SEQ ID NO: 21721 - RNA, 20 nt, Artificial Sequence
  targeting sequence with TTCN PAM
gaaaugguuuuucccuugcu

SEQ ID NO: 21722 - RNA, 20 nt, Artificial Sequence
  targeting sequence with TTCN PAM
gaauccauaaccauugcaau

SEQ ID NO: 21723 - RNA, 20 nt, Artificial Sequence
  targeting sequence with TTCN PAM
cuugcuguguguucuuuuuc

SEQ ID NO: 21724 - RNA, 20 nt, Artificial Sequence
  targeting sequence with TTCN PAM
uuuuccucagauuggaaagg

SEQ ID NO: 21725 - RNA, 20 nt, Artificial Sequence
  targeting sequence with TTCN PAM
ucagauuggaaaggaucggg

SEQ ID NO: 21726 - RNA, 20 nt, Artificial Sequence
  targeting sequence with TTCN PAM
aaucugaggaaaaagaacac

SEQ ID NO: 21727 - RNA, 20 nt, Artificial Sequence
  targeting sequence with TTCN PAM
gugcccgauccuuuccaauc

SEQ ID NO: 21728 - RNA, 20 nt, Artificial Sequence
  targeting sequence with TTCN PAM
gacaagcaaguaucucuuuu

SEQ ID NO: 21729 - RNA, 20 nt, Artificial Sequence
  targeting sequence with TTCN PAM
ccaaggauggagugcggcuu

SEQ ID NO: 21730 - RNA, 20 nt, Artificial Sequence
  targeting sequence with TTCN PAM
gcuccccaacagucccaagc

SEQ ID NO: 21731 - RNA, 20 nt, Artificial Sequence
  targeting sequence with TTCN PAM
cuugacacguccacacccag

SEQ ID NO: 21732 - RNA, 20 nt, Artificial Sequence
  targeting sequence with TTCN PAM
aacuaugugguaagaagaga

SEQ ID NO: 21733 - RNA, 20 nt, Artificial Sequence
  targeting sequence with TTCN PAM
uaccacauaguuggaauccg

SEQ ID NO: 21734 - RNA, 20 nt, Artificial Sequence
  targeting sequence with TTCN PAM
cuucuuaccacauaguugga

SEQ ID NO: 21735 - RNA, 20 nt, Artificial Sequence
  targeting sequence with TTCN PAM
guggggccauggcuugaaga

SEQ ID NO: 21736 - RNA, 20 nt, Artificial Sequence
  targeting sequence with TTCN PAM
agccauggccccacagaaca

SEQ ID NO: 21737 - RNA, 20 nt, Artificial Sequence
  targeting sequence with TTCN PAM
cagcucucuggagaaagucu

SEQ ID NO: 21738 - RNA, 20 nt, Artificial Sequence
  targeting sequence with TTCN PAM
cucaccccgcagguggucgg

SEQ ID NO: 21739 - RNA, 20 nt, Artificial Sequence
  targeting sequence with TTCN PAM
uucuaccagcuuauuuucag

SEQ ID NO: 21740 - RNA, 20 nt, Artificial Sequence
  targeting sequence with TTCN PAM
accagcuuauuuucagcaca

SEQ ID NO: 21741 - RNA, 20 nt, Artificial Sequence
  targeting sequence with TTCN PAM
gcacaguccaugggcuuuac

SEQ ID NO: 21742 - RNA, 20 nt, Artificial Sequence
  targeting sequence with TTCN PAM
gcucagugaucaggugcugc

SEQ ID NO: 21743 - RNA, 20 nt, Artificial Sequence
  targeting sequence with TTCN PAM
caaggucuggaccugccucu

SEQ ID NO: 21744 - RNA, 20 nt, Artificial Sequence
  targeting sequence with TTCN PAM
gguguauucauaucuggaug

SEQ ID NO: 21745 - RNA, 20 nt, Artificial Sequence
  targeting sequence with TTCN PAM
gaucaccgggggccacuagu

SEQ ID NO: 21746 - RNA, 20 nt, Artificial Sequence
  targeting sequence with TTCN PAM
gcagaguugauuguauguau

SEQ ID NO: 21747 - RNA, 20 nt, Artificial Sequence
  targeting sequence with TTCN PAM
augagaguaucucacuuuaa

SEQ ID NO: 21748 - RNA, 20 nt, Artificial Sequence
  targeting sequence with TTCN PAM
cugccuugcaccuuacauaa

SEQ ID NO: 21749 - RNA, 20 nt, Artificial Sequence
  targeting sequence with TTCN PAM
agcaagagguuguuauguaa

SEQ ID NO: 21750 - RNA, 20 nt, Artificial Sequence
  targeting sequence with TTCN PAM
uugacaguucggauuaaaug

SEQ ID NO: 21751 - RNA, 20 nt, Artificial Sequence
  targeting sequence with TTCN PAM
gauuaaaugcaaagagcuug

SEQ ID NO: 21752 - RNA, 20 nt, Artificial Sequence
  targeting sequence with TTCN PAM
ugacaagcucuuugcauuua

SEQ ID NO: 21753 - RNA, 20 nt, Artificial Sequence
  targeting sequence with TTCN PAM
guagauggcaaucuucuuga

SEQ ID NO: 21754 - RNA, 20 nt, Artificial Sequence
  targeting sequence with TTCN PAM
cuggcaguuggauagccaau

SEQ ID NO: 21755 - RNA, 20 nt, Artificial Sequence
  targeting sequence with TTCN PAM
gaggacuuaucagacaugca

SEQ ID NO: 21756 - RNA, 20 nt, Artificial Sequence
  targeting sequence with TTCN PAM
ccuuuacccgguaaugcaug

SEQ ID NO: 21757 - RNA, 20 nt, Artificial Sequence
  targeting sequence with TTCN PAM
ugauaaucuucuccuuuacc

SEQ ID NO: 21758 - RNA, 20 nt, Artificial Sequence
  targeting sequence with TTCN PAM
acaugcugcugcccaccugg

SEQ ID NO: 21759 - RNA, 20 nt, Artificial Sequence
  targeting sequence with TTCN PAM
gcccaacuccuucaacaugc

SEQ ID NO: 21760 - RNA, 20 nt, Artificial Sequence
  targeting sequence with TTCN PAM
auuugugcuccccccccagu

SEQ ID NO: 21761 - RNA, 20 nt, Artificial Sequence
  targeting sequence with TTCN PAM
ccaguuuauggcucaugacu

SEQ ID NO: 21762 - RNA, 20 nt, Artificial Sequence
  targeting sequence with TTCN PAM
uaaaguacugggauuauagg

SEQ ID NO: 21763 - RNA, 20 nt, Artificial Sequence
  targeting sequence with TTCN PAM
uggcuagacacaguggcuca

SEQ ID NO: 21764 - RNA, 20 nt, Artificial Sequence
  targeting sequence with TTCN PAM
guacaccaauuuauguuuua

SEQ ID NO: 21765 - RNA, 20 nt, Artificial Sequence
  targeting sequence with TTCN PAM
uucuguacaccaauuuaugu

SEQ ID NO: 21766 - RNA, 20 nt, Artificial Sequence
  targeting sequence with TTCN PAM
uugacaauuacugaguugau

SEQ ID NO: 21767 - RNA, 20 nt, Artificial Sequence
  targeting sequence with TTCN PAM
ugaaagauuuuuuuucauag

SEQ ID NO: 21768 - RNA, 20 nt, Artificial Sequence
  targeting sequence with TTCN PAM
ggaauuaaaacuuccuugac

SEQ ID NO: 21769 - RNA, 20 nt, Artificial Sequence
  targeting sequence with TTCN PAM
uagaaaaauauuucucaaga

SEQ ID NO: 21770 - RNA, 20 nt, Artificial Sequence
  targeting sequence with TTCN PAM
augaaaaaaaaucuuucagg

SEQ ID NO: 21771 - RNA, 20 nt, Artificial Sequence
  targeting sequence with TTCN PAM
caagauucuuagagaguguc

SEQ ID NO: 21772 - RNA, 20 nt, Artificial Sequence
  targeting sequence with TTCN PAM
uagagagugucuaagucaau

SEQ ID NO: 21773 - RNA, 20 nt, Artificial Sequence
  targeting sequence with TTCN PAM
cuuggcauugacuuagacac

SEQ ID NO: 21774 - RNA, 20 nt, Artificial Sequence
  targeting sequence with TTCN PAM
aaacuucucuuggcauugac

SEQ ID NO: 21775 - RNA, 20 nt, Artificial Sequence
  targeting sequence with TTCN PAM
cucaaagucuuuccaaacuu

SEQ ID NO: 21776 - RNA, 20 nt, Artificial Sequence
  targeting sequence with TTCN PAM
aagaugcugggcuagccuuc

SEQ ID NO: 21777 - RNA, 20 nt, Artificial Sequence
  targeting sequence with TTCN PAM
guuggaggugauaaaagaga

SEQ ID NO: 21778 - RNA, 20 nt, Artificial Sequence
  targeting sequence with TTCN PAM
aacuuugauuauuuauuuau

SEQ ID NO: 21779 - RNA, 20 nt, Artificial Sequence
  targeting sequence with TTCN PAM
augcaaacccccacccaggc

SEQ ID NO: 21780 - RNA, 20 nt, Artificial Sequence
  targeting sequence with TTCN PAM
gccucagaucuucaaugcaa

SEQ ID NO: 21781 - RNA, 20 nt, Artificial Sequence
  targeting sequence with TTCN PAM
ccacggagcccaauucagcc

SEQ ID NO: 21782 - RNA, 20 nt, Artificial Sequence
  targeting sequence with TTCN PAM
guauccaucuaucuaaccca

SEQ ID NO: 21783 - RNA, 20 nt, Artificial Sequence
  targeting sequence with TTCN PAM
ccccuuagggacagaaagau

SEQ ID NO: 21784 - RNA, 20 nt, Artificial Sequence
  targeting sequence with TTCN PAM
gucccuaaggggagaaaaua

SEQ ID NO: 21785 - RNA, 20 nt, Artificial Sequence
  targeting sequence with TTCN PAM
guugaauuuccaugcagagc

SEQ ID NO: 21786 - RNA, 20 nt, Artificial Sequence
  targeting sequence with TTCN PAM
acagaauaagugcccccaga

SEQ ID NO: 21787 - RNA, 20 nt, Artificial Sequence
  targeting sequence with TTCN PAM
augcagagcuggguuugcuu

SEQ ID NO: 21788 - RNA, 20 nt, Artificial Sequence
  targeting sequence with TTCN PAM
uaggagaaacggcugcagug

SEQ ID NO: 21789 - RNA, 20 nt, Artificial Sequence
  targeting sequence with TTCN PAM
ccuaggaagcaaacccagcu

SEQ ID NO: 21790 - RNA, 20 nt, Artificial Sequence
  targeting sequence with TTCN PAM
gcggagugaaggagcgggag

SEQ ID NO: 21791 - RNA, 20 nt, Artificial Sequence
  targeting sequence with TTCN PAM
cuccgcugaaggacaggcac

SEQ ID NO: 21792 - RNA, 20 nt, Artificial Sequence
  targeting sequence with TTCN PAM
uuacaucaaggugaucggug

SEQ ID NO: 21793 - RNA, 20 nt, Artificial Sequence
  targeting sequence with TTCN PAM
aggagggccaccgaucaccu

SEQ ID NO: 21794 - RNA, 20 nt, Artificial Sequence
  targeting sequence with TTCN PAM
cuuccaggagggccaccgau

SEQ ID NO: 21795 - RNA, 20 nt, Artificial Sequence
  targeting sequence with TTCN PAM
gccccacuaagaggccuucu

SEQ ID NO: 21796 - RNA, 20 nt, Artificial Sequence
  targeting sequence with TTCN PAM
ucagccccacuaagaggccu

SEQ ID NO: 21797 - RNA, 20 nt, Artificial Sequence
  targeting sequence with TTCN PAM
cagggcaggaaaagggcuuc

SEQ ID NO: 21798 - RNA, 20 nt, Artificial Sequence
  targeting sequence with TTCN PAM
ugcccugagaacccagcuca

SEQ ID NO: 21799 - RNA, 20 nt, Artificial Sequence
  targeting sequence with TTCN PAM
cuccuccaugggugaauugu

SEQ ID NO: 21800 - RNA, 20 nt, Artificial Sequence
  targeting sequence with TTCN PAM
cccauggaggagagaagccc

SEQ ID NO: 21801 - RNA, 20 nt, Artificial Sequence
  targeting sequence with TTCN PAM
guuuuuugaggacagccuca

SEQ ID NO: 21802 - RNA, 20 nt, Artificial Sequence
  targeting sequence with TTCN PAM
ggagaccuuaagccacuaau

SEQ ID NO: 21803 - RNA, 20 nt, Artificial Sequence
  targeting sequence with TTCN PAM
guggauuucuagagggaggc

SEQ ID NO: 21804 - RNA, 20 nt, Artificial Sequence
  targeting sequence with TTCN PAM
agagggaggcagagaucguu

SEQ ID NO: 21805 - RNA, 20 nt, Artificial Sequence
  targeting sequence with TTCN PAM
agcauguguccuaaagaaug

SEQ ID NO: 21806 - RNA, 20 nt, Artificial Sequence
  targeting sequence with TTCN PAM
uuaggacacaugcuggaacg

SEQ ID NO: 21807 - RNA, 20 nt, Artificial Sequence
  targeting sequence with TTCN PAM
guguguguguauacaugugu

SEQ ID NO: 21808 - RNA, 20 nt, Artificial Sequence
  targeting sequence with TTCN PAM
uugcucagcauaagaaaagu

SEQ ID NO: 21809 - RNA, 20 nt, Artificial Sequence
  targeting sequence with TTCN PAM
uaugcugagcaaagaacaca

SEQ ID NO: 21810 - RNA, 20 nt, Artificial Sequence
  targeting sequence with TTCN PAM
aaguaggcugcuacauggaa

SEQ ID NO: 21811 - RNA, 20 nt, Artificial Sequence
  targeting sequence with TTCN PAM
auguagcagccuacuuagaa

SEQ ID NO: 21812 - RNA, 20 nt, Artificial Sequence
  targeting sequence with TTCN PAM
aaguuccauguagcagccua

SEQ ID NO: 21813 - RNA, 20 nt, Artificial Sequence
  targeting sequence with TTCN PAM
auccccagcaaagaccugac

SEQ ID NO: 21814 - RNA, 20 nt, Artificial Sequence
  targeting sequence with TTCN PAM
cccacugcucucaugcccug

SEQ ID NO: 21815 - RNA, 20 nt, Artificial Sequence
  targeting sequence with TTCN PAM
uagggcugucaaaaacagau

SEQ ID NO: 21816 - RNA, 20 nt, Artificial Sequence
  targeting sequence with TTCN PAM
accacaugucuugucagugu

SEQ ID NO: 21817 - RNA, 20 nt, Artificial Sequence
  targeting sequence with TTCN PAM
uaguagcuuuuuccuguguu

SEQ ID NO: 21818 - RNA, 20 nt, Artificial Sequence
  targeting sequence with TTCN PAM
uguguuaguucgugacucag

SEQ ID NO: 21819 - RNA, 20 nt, Artificial Sequence
  targeting sequence with TTCN PAM
ugacucagaucucugcuagg

SEQ ID NO: 21820 - RNA, 20 nt, Artificial Sequence
  targeting sequence with TTCN PAM
gacuggggauuuguugauga

SEQ ID NO: 21821 - RNA, 20 nt, Artificial Sequence
  targeting sequence with TTCN PAM
gugucuguucggacugggga

SEQ ID NO: 21822 - RNA, 20 nt, Artificial Sequence
  targeting sequence with TTCN PAM
gcagccucugaugaaccucg

SEQ ID NO: 21823 - RNA, 20 nt, Artificial Sequence
  targeting sequence with TTCN PAM
ucagaggcugcagaaguaau

SEQ ID NO: 21824 - RNA, 20 nt, Artificial Sequence
  targeting sequence with TTCN PAM
ggccuccuaaggauaagcca

SEQ ID NO: 21825 - RNA, 20 nt, Artificial Sequence
  targeting sequence with TTCN PAM
uuugaugaguccuuuucccu

SEQ ID NO: 21826 - RNA, 20 nt, Artificial Sequence
  targeting sequence with TTCN PAM
cugcacagagcuucugguga

SEQ ID NO: 21827 - RNA, 20 nt, Artificial Sequence
  targeting sequence with TTCN PAM
ggugaagguggugggaguug

SEQ ID NO: 21828 - RNA, 20 nt, Artificial Sequence
  targeting sequence with TTCN PAM
ccagaagcucugugcaggga

SEQ ID NO: 21829 - RNA, 20 nt, Artificial Sequence
  targeting sequence with TTCN PAM
ugcagagcacaugggauucc

SEQ ID NO: 21830 - RNA, 20 nt, Artificial Sequence
  targeting sequence with TTCN PAM
aacggccuggcagugggcca

SEQ ID NO: 21831 - RNA, 20 nt, Artificial Sequence
  targeting sequence with TTCN PAM
cugaaauuuugccagauccu

SEQ ID NO: 21832 - RNA, 20 nt, Artificial Sequence
  targeting sequence with TTCN PAM
gcgaaaacagugucagucac

SEQ ID NO: 21833 - RNA, 20 nt, Artificial Sequence
  targeting sequence with TTCN PAM
ggaucuggcaaaauuucagc

SEQ ID NO: 21834 - RNA, 20 nt, Artificial Sequence
  targeting sequence with TTCN PAM
uggacaaucucuuugcuauc

SEQ ID NO: 21835 - RNA, 20 nt, Artificial Sequence
  targeting sequence with TTCN PAM
gcaggacgauagcaaagaga

SEQ ID NO: 21836 - RNA, 20 nt, Artificial Sequence
  targeting sequence with TTCN PAM
uacgggaggcacucaugucc

SEQ ID NO: 21837 - RNA, 20 nt, Artificial Sequence
  targeting sequence with TTCN PAM
ucuaccacggccagcuucuu

SEQ ID NO: 21838 - RNA, 20 nt, Artificial Sequence
  targeting sequence with TTCN PAM
ggugaagucccugagggggc

SEQ ID NO: 21839 - RNA, 20 nt, Artificial Sequence
  targeting sequence with TTCN PAM
ccugaaaaagcagcuccuug

SEQ ID NO: 21840 - RNA, 20 nt, Artificial Sequence
  targeting sequence with TTCN PAM
cagucccugcaggaggcucu

SEQ ID NO: 21841 - RNA, 20 nt, Artificial Sequence
  targeting sequence with TTCN PAM
uugccaauggaaaccgaagg

SEQ ID NO: 21842 - RNA, 20 nt, Artificial Sequence
  targeting sequence with TTCN PAM
auuggcaaggaaaccaaagu

SEQ ID NO: 21843 - RNA, 20 nt, Artificial Sequence
  targeting sequence with TTCN PAM
guuuccauuggcaaggaaac

SEQ ID NO: 21844 - RNA, 20 nt, Artificial Sequence
  targeting sequence with TTCN PAM
uaagcguuuaccaugaacaa

SEQ ID NO: 21845 - RNA, 20 nt, Artificial Sequence
  targeting sequence with TTCN PAM
ugguaaacgcuuaagaaagg

SEQ ID NO: 21846 - RNA, 20 nt, Artificial Sequence
  targeting sequence with TTCN PAM
uguucaugguaaacgcuuaa

SEQ ID NO: 21847 - RNA, 20 nt, Artificial Sequence
  targeting sequence with TTCN PAM
cugagugccaacgucacacc

SEQ ID NO: 21848 - RNA, 20 nt, Artificial Sequence
  targeting sequence with TTCN PAM
uuugcagaagucugugucuc

SEQ ID NO: 21849 - RNA, 20 nt, Artificial Sequence
  targeting sequence with TTCN PAM
gcaaaggaagugcauccauc

SEQ ID NO: 21850 - RNA, 20 nt, Artificial Sequence
  targeting sequence with TTCN PAM
cacgcuguaggugcgcauag

SEQ ID NO: 21851 - RNA, 20 nt, Artificial Sequence
  targeting sequence with TTCN PAM
uucccacgcuguaggugcgc

SEQ ID NO: 21852 - RNA, 20 nt, Artificial Sequence
  targeting sequence with TTCN PAM
gaugacaaaacauccuguuu

SEQ ID NO: 21853 - RNA, 20 nt, Artificial Sequence
  targeting sequence with TTCN PAM
cccuuucagaugacaaaaca

SEQ ID NO: 21854 - RNA, 20 nt, Artificial Sequence
  targeting sequence with TTCN PAM
acuuaauucacaagaaugcu

SEQ ID NO: 21855 - RNA, 20 nt, Artificial Sequence
  targeting sequence with TTCN PAM
caagaaugcuagaagagcca

SEQ ID NO: 21856 - RNA, 20 nt, Artificial Sequence
  targeting sequence with TTCN PAM
ugugaauuaaguagaaggcc

SEQ ID NO: 21857 - RNA, 20 nt, Artificial Sequence
  targeting sequence with TTCN PAM
agcauucuugugaauuaagu

SEQ ID NO: 21858 - RNA, 20 nt, Artificial Sequence
  targeting sequence with TTCN PAM
gcuggcucuucuagcauucu

SEQ ID NO: 21859 - RNA, 20 nt, Artificial Sequence
  targeting sequence with TTCN PAM
cauucugcuggcucuucuag

SEQ ID NO: 21860 - RNA, 20 nt, Artificial Sequence
  targeting sequence with TTCN PAM
guggagucauccagcccugu

SEQ ID NO: 21861 - RNA, 20 nt, Artificial Sequence
  targeting sequence with TTCN PAM
ucaggccacagggcuggaug

SEQ ID NO: 21862 - RNA, 20 nt, Artificial Sequence
  targeting sequence with TTCN PAM
cuggugacacacuuccucag

SEQ ID NO: 21863 - RNA, 20 nt, Artificial Sequence
  targeting sequence with TTCN PAM
gcugggcucgcgccauucuu

SEQ ID NO: 21864 - RNA, 20 nt, Artificial Sequence
  targeting sequence with TTCN PAM
uucucucuuuaggucuuugu

SEQ ID NO: 21865 - RNA, 20 nt, Artificial Sequence
  targeting sequence with TTCN PAM
cucuuuaggucuuuguaggu

SEQ ID NO: 21866 - RNA, 20 nt, Artificial Sequence
  targeting sequence with TTCN PAM
agagugaaguuccccccaaa

SEQ ID NO: 21867 - RNA, 20 nt, Artificial Sequence
  targeting sequence with TTCN PAM
cucuggaaaaccaguccuga

SEQ ID NO: 21868 - RNA, 20 nt, Artificial Sequence
  targeting sequence with TTCN PAM
ccccaaagcuggagccccuc

SEQ ID NO: 21869 - RNA, 20 nt, Artificial Sequence
  targeting sequence with TTCN PAM
ucggccacugcaggguuucc

SEQ ID NO: 21870 - RNA, 20 nt, Artificial Sequence
  targeting sequence with TTCN PAM
ugauguuaugggcagauuca

SEQ ID NO: 21871 - RNA, 20 nt, Artificial Sequence
  targeting sequence with TTCN PAM
guccccuuaccaggcuccuc

SEQ ID NO: 21872 - RNA, 20 nt, Artificial Sequence
  targeting sequence with TTCN PAM
cagcagcagaaucgaugggg

SEQ ID NO: 21873 - RNA, 20 nt, Artificial Sequence
  targeting sequence with TTCN PAM
gcugcugagaacaaggagga

SEQ ID NO: 21874 - RNA, 20 nt, Artificial Sequence
  targeting sequence with TTCN PAM
aauugacugaggcugcuccc

SEQ ID NO: 21875 - RNA, 20 nt, Artificial Sequence
  targeting sequence with TTCN PAM
acucucucaaggacaugagu

SEQ ID NO: 21876 - RNA, 20 nt, Artificial Sequence
  targeting sequence with TTCN PAM
gggaaagagagggcauagcc

SEQ ID NO: 21877 - RNA, 20 nt, Artificial Sequence
  targeting sequence with TTCN PAM
ccgaaaccauucuacucucu

SEQ ID NO: 21878 - RNA, 20 nt, Artificial Sequence
  targeting sequence with TTCN PAM
agcugaccugggcuuggguc

SEQ ID NO: 21879 - RNA, 20 nt, Artificial Sequence
  targeting sequence with TTCN PAM
cuaaaaugaaauuaguaauu

SEQ ID NO: 21880 - RNA, 20 nt, Artificial Sequence
  targeting sequence with TTCN PAM
uuuuagagaaaaguaauuaa

SEQ ID NO: 21881 - RNA, 20 nt, Artificial Sequence
  targeting sequence with TTCN PAM
guaaggggcaauuacuaauu

SEQ ID NO: 21882 - RNA, 20 nt, Artificial Sequence
  targeting sequence with TTCN PAM
uguagcaauucuguaagggg

SEQ ID NO: 21883 - RNA, 20 nt, Artificial Sequence
  targeting sequence with TTCN PAM
ggccccauuuugugcucaac

SEQ ID NO: 21884 - RNA, 20 nt, Artificial Sequence
  targeting sequence with TTCN PAM
cuucuccccagccucaccuc

SEQ ID NO: 21885 - RNA, 20 nt, Artificial Sequence
  targeting sequence with TTCN PAM
ccccagccucaccucccacc

SEQ ID NO: 21886 - RNA, 20 nt, Artificial Sequence
  targeting sequence with TTCN PAM
cagcccugccaggagacauc

SEQ ID NO: 21887 - RNA, 20 nt, Artificial Sequence
  targeting sequence with TTCN PAM
cagcuguaacauugccugcu

SEQ ID NO: 21888 - RNA, 20 nt, Artificial Sequence
  targeting sequence with TTCN PAM
gccuaggaucuuuuauaaug

SEQ ID NO: 21889 - RNA, 20 nt, Artificial Sequence
  targeting sequence with TTCN PAM
ggagaauaauuuuuuuucaa

SEQ ID NO: 21890 - RNA, 20 nt, Artificial Sequence
  targeting sequence with TTCN PAM
ccugaaauaugcucauaccu

SEQ ID NO: 21891 - RNA, 20 nt, Artificial Sequence
  targeting sequence with TTCN PAM
aaaguaauacuugcuuacuc

SEQ ID NO: 21892 - RNA, 20 nt, Artificial Sequence
  targeting sequence with TTCN PAM
aacaacacgcaggugcaugg

SEQ ID NO: 21893 - RNA, 20 nt, Artificial Sequence
  targeting sequence with TTCN PAM
cacaggauccccacuguccc

SEQ ID NO: 21894 - RNA, 20 nt, Artificial Sequence
  targeting sequence with TTCN PAM
ccaggaaccaaacgccaaca

SEQ ID NO: 21895 - RNA, 20 nt, Artificial Sequence
  targeting sequence with TTCN PAM
uggggaacagggacaguggg

SEQ ID NO: 21896 - RNA, 20 nt, Artificial Sequence
  targeting sequence with TTCN PAM
aagcuacacuguuggcguuu

SEQ ID NO: 21897 - RNA, 20 nt, Artificial Sequence
  targeting sequence with TTCN PAM
cgggaggaggcuaccucaac

SEQ ID NO: 21898 - RNA, 20 nt, Artificial Sequence
  targeting sequence with TTCN PAM
cugugcaccggcagaagcug

SEQ ID NO: 21899 - RNA, 20 nt, Artificial Sequence
  targeting sequence with TTCN PAM
gccggugcacagggaaggug

SEQ ID NO: 21900 - RNA, 20 nt, Artificial Sequence
  targeting sequence with TTCN PAM
gccuccaugucuucuccauu

SEQ ID NO: 21901 - RNA, 20 nt, Artificial Sequence
  targeting sequence with TTCN PAM
ccauuucugccguggaggug

SEQ ID NO: 21902 - RNA, 20 nt, Artificial Sequence
  targeting sequence with TTCN PAM
gccguggaggugccgcaggu

SEQ ID NO: 21903 - RNA, 20 nt, Artificial Sequence
  targeting sequence with TTCN PAM
caucccuuccuuuauggcua

SEQ ID NO: 21904 - RNA, 20 nt, Artificial Sequence
  targeting sequence with TTCN PAM
uuuauggcuaucuucucauu

SEQ ID NO: 21905 - RNA, 20 nt, Artificial Sequence
  targeting sequence with TTCN PAM
cauuucaccucacauucggu

SEQ ID NO: 21906 - RNA, 20 nt, Artificial Sequence
  targeting sequence with TTCN PAM
ccucacauucgguuauggca

SEQ ID NO: 21907 - RNA, 20 nt, Artificial Sequence
  targeting sequence with TTCN PAM
guuauggcagccccaucacu

SEQ ID NO: 21908 - RNA, 20 nt, Artificial Sequence
  targeting sequence with TTCN PAM
uagacagugauggggcugcc

SEQ ID NO: 21909 - RNA, 20 nt, Artificial Sequence
  targeting sequence with TTCN PAM
cucaacaaucuccuaaagca

SEQ ID NO: 21910 - RNA, 20 nt, Artificial Sequence
  targeting sequence with TTCN PAM
gugucaguaaaugguaaaug

SEQ ID NO: 21911 - RNA, 20 nt, Artificial Sequence
  targeting sequence with TTCN PAM
uauucugcauggcaaaauuu

SEQ ID NO: 21912 - RNA, 20 nt, Artificial Sequence
  targeting sequence with TTCN PAM
gcauggcaaaauuuagggua

SEQ ID NO: 21913 - RNA, 20 nt, Artificial Sequence
  targeting sequence with TTCN PAM
uacaauuuaugugagucuac

SEQ ID NO: 21914 - RNA, 20 nt, Artificial Sequence
  targeting sequence with TTCN PAM
cccaacgguaacagugugca

SEQ ID NO: 21915 - RNA, 20 nt, Artificial Sequence
  targeting sequence with TTCN PAM
cacccauguuggcaugugua

SEQ ID NO: 21916 - RNA, 20 nt, Artificial Sequence
  targeting sequence with TTCN PAM
gugccaugacugugguggga

SEQ ID NO: 21917 - RNA, 20 nt, Artificial Sequence
  targeting sequence with TTCN PAM
acagcuuucuuuaccagucc

SEQ ID NO: 21918 - RNA, 20 nt, Artificial Sequence
  targeting sequence with TTCN PAM
uuaccaguccuacuggacau

SEQ ID NO: 21919 - RNA, 20 nt, Artificial Sequence
  targeting sequence with TTCN PAM
agcuagguccuugcaccugu

SEQ ID NO: 21920 - RNA, 20 nt, Artificial Sequence
  targeting sequence with TTCN PAM
uagaaaugaaauugcugggu

SEQ ID NO: 21921 - RNA, 20 nt, Artificial Sequence
  targeting sequence with TTCN PAM
aggaauuuaugccaaggcgc

SEQ ID NO: 21922 - RNA, 20 nt, Artificial Sequence
  targeting sequence with TTCN PAM
uuucuaggaauuuaugccaa

SEQ ID NO: 21923 - RNA, 20 nt, Artificial Sequence
  targeting sequence with TTCN PAM
aagguacacgugcuuugacc

SEQ ID NO: 21924 - RNA, 20 nt, Artificial Sequence
  targeting sequence with TTCN PAM
cuaaaagucuuucaaaggua

SEQ ID NO: 21925 - RNA, 20 nt, Artificial Sequence
  targeting sequence with TTCN PAM
agguuucccuuccgcuaggc

SEQ ID NO: 21926 - RNA, 20 nt, Artificial Sequence
  targeting sequence with TTCN PAM
cuuccgcuaggcucugucag

SEQ ID NO: 21927 - RNA, 20 nt, Artificial Sequence
  targeting sequence with TTCN PAM
gcuaggcucugucagucugu

SEQ ID NO: 21928 - RNA, 20 nt, Artificial Sequence
  targeting sequence with TTCN PAM
ccauacaacucagcuucagg

SEQ ID NO: 21929 - RNA, 20 nt, Artificial Sequence
  targeting sequence with TTCN PAM
ggcuagagcccacuucuucu

SEQ ID NO: 21930 - RNA, 20 nt, Artificial Sequence
  targeting sequence with TTCN PAM
ucuaaguugaugauacccuc

SEQ ID NO: 21931 - RNA, 20 nt, Artificial Sequence
  targeting sequence with TTCN PAM
aaguugaugauacccucgaa

SEQ ID NO: 21932 - RNA, 20 nt, Artificial Sequence
  targeting sequence with TTCN PAM
aggguaucaucaacuuagaa

SEQ ID NO: 21933 - RNA, 20 nt, Artificial Sequence
  targeting sequence with TTCN PAM
ccaguaagucuugcagucau

SEQ ID NO: 21934 - RNA, 20 nt, Artificial Sequence
  targeting sequence with TTCN PAM
agaaauguuaguggaauuca

SEQ ID NO: 21935 - RNA, 20 nt, Artificial Sequence
  targeting sequence with TTCN PAM
ugaauagcugaucuguguca

SEQ ID NO: 21936 - RNA, 20 nt, Artificial Sequence
  targeting sequence with TTCN PAM
acuaacauuucuugaauagc

SEQ ID NO: 21937 - RNA, 20 nt, Artificial Sequence
  targeting sequence with TTCN PAM
gaucugaggaaaaagaccag

SEQ ID NO: 21938 - RNA, 20 nt, Artificial Sequence
  targeting sequence with TTCN PAM
ucagaucugaauuccacuaa

SEQ ID NO: 21939 - RNA, 20 nt, Artificial Sequence
  targeting sequence with TTCN PAM
ggucuuuuuccucagaucug

SEQ ID NO: 21940 - RNA, 20 nt, Artificial Sequence
  targeting sequence with TTCN PAM
ucuugcuuucuggucuuuuu

SEQ ID NO: 21941 - RNA, 20 nt, Artificial Sequence
  targeting sequence with TTCN PAM
uccucuugcuuucuggucuu

SEQ ID NO: 21942 - RNA, 20 nt, Artificial Sequence
  targeting sequence with TTCN PAM
cuucuuccucuugcuuucug

SEQ ID NO: 21943 - RNA, 20 nt, Artificial Sequence
  targeting sequence with TTCN PAM
acccaccucauucccuucuu

SEQ ID NO: 21944 - RNA, 20 nt, Artificial Sequence
  targeting sequence with TTCN PAM
ugccccucguccugcugcca

SEQ ID NO: 21945 - RNA, 20 nt, Artificial Sequence
  targeting sequence with TTCN PAM
ccuggacuguguccucguca

SEQ ID NO: 21946 - RNA, 20 nt, Artificial Sequence
  targeting sequence with TTCN PAM
ugguggauguggugcguggg

SEQ ID NO: 21947 - RNA, 20 nt, Artificial Sequence
  targeting sequence with TTCN PAM
cccaagauugccauccugac

SEQ ID NO: 21948 - RNA, 20 nt, Artificial Sequence
  targeting sequence with TTCN PAM
ucugccaggacuuuaagauu

SEQ ID NO: 21949 - RNA, 20 nt, Artificial Sequence
  targeting sequence with TTCN PAM
gcagcaaagucuugcugacu

SEQ ID NO: 21950 - RNA, 20 nt, Artificial Sequence
  targeting sequence with TTCN PAM
uaacccuuggcaguccugac

SEQ ID NO: 21951 - RNA, 20 nt, Artificial Sequence
  targeting sequence with TTCN PAM
caagacaaaggcuguucauc

SEQ ID NO: 21952 - RNA, 20 nt, Artificial Sequence
  targeting sequence with TTCN PAM
ucugucgccucugccuccgg

SEQ ID NO: 21953 - RNA, 20 nt, Artificial Sequence
  targeting sequence with TTCN PAM
cccuccucucugggccaaaa

SEQ ID NO: 21954 - RNA, 20 nt, Artificial Sequence
  targeting sequence with TTCN PAM
aagacugggucugaugcuuu

SEQ ID NO: 21955 - RNA, 20 nt, Artificial Sequence
  targeting sequence with TTCN PAM
aaauuuacauugucuugugc

SEQ ID NO: 21956 - RNA, 20 nt, Artificial Sequence
  targeting sequence with TTCN PAM
aaaggcaaccaaaaauucca

SEQ ID NO: 21957 - RNA, 20 nt, Artificial Sequence
  targeting sequence with TTCN PAM
ugcacaagacaauguaaauu

SEQ ID NO: 21958 - RNA, 20 nt, Artificial Sequence
  targeting sequence with TTCN PAM
caaggcgguggugacuucau

SEQ ID NO: 21959 - RNA, 20 nt, Artificial Sequence
  targeting sequence with TTCN PAM
uguuugaaauccaacagcaa

SEQ ID NO: 21960 - RNA, 20 nt, Artificial Sequence
  targeting sequence with TTCN PAM
aacaugaagucaccaccgcc

SEQ ID NO: 21961 - RNA, 20 nt, Artificial Sequence
  targeting sequence with TTCN PAM
guggggucuauuuuuaaaac

SEQ ID NO: 21962 - RNA, 20 nt, Artificial Sequence
  targeting sequence with TTCN PAM
gggaaggagcaccagcuuuc

SEQ ID NO: 21963 - RNA, 20 nt, Artificial Sequence
  targeting sequence with TTCN PAM
ccgaaccacaccaacugcuu

SEQ ID NO: 21964 - RNA, 20 nt, Artificial Sequence
  targeting sequence with TTCN PAM
guccugacucugccaucuca

SEQ ID NO: 21965 - RNA, 20 nt, Artificial Sequence
  targeting sequence with TTCN PAM
cucuuuggggccucauuucu

SEQ ID NO: 21966 - RNA, 20 nt, Artificial Sequence
  targeting sequence with TTCN PAM
uuucugugaaaugggguuaa

SEQ ID NO: 21967 - RNA, 20 nt, Artificial Sequence
  targeting sequence with TTCN PAM
gugaaaugggguuaauuaua

SEQ ID NO: 21968 - RNA, 20 nt, Artificial Sequence
  targeting sequence with TTCN PAM
cagaaaagaaaugaggcccc

SEQ ID NO: 21969 - RNA, 20 nt, Artificial Sequence
  targeting sequence with TTCN PAM
gguuucgucaagccaaauuu

SEQ ID NO: 21970 - RNA, 20 nt, Artificial Sequence
  targeting sequence with TTCN PAM
ucaagccaaauuucuauuau

SEQ ID NO: 21971 - RNA, 20 nt, Artificial Sequence
  targeting sequence with TTCN PAM
auuauuauuucuccuuauua

SEQ ID NO: 21972 - RNA, 20 nt, Artificial Sequence
  targeting sequence with TTCN PAM
ccuuauuacugacucauaaa

SEQ ID NO: 21973 - RNA, 20 nt, Artificial Sequence
  targeting sequence with TTCN PAM
aaaguccgucaguaaguaca

SEQ ID NO: 21974 - RNA, 20 nt, Artificial Sequence
  targeting sequence with TTCN PAM
uuucuaaaguccgucaguaa

SEQ ID NO: 21975 - RNA, 20 nt, Artificial Sequence
  targeting sequence with TTCN PAM
uaaagcacacaaugagcuuu

SEQ ID NO: 21976 - RNA, 20 nt, Artificial Sequence
  targeting sequence with TTCN PAM
ggaguuugagaaagcuucca

SEQ ID NO: 21977 - RNA, 20 nt, Artificial Sequence
  targeting sequence with TTCN PAM
caaacuccugaaagcuuuuc

SEQ ID NO: 21978 - RNA, 20 nt, Artificial Sequence
  targeting sequence with TTCN PAM
aggagauggugaaacuugau

SEQ ID NO: 21979 - RNA, 20 nt, Artificial Sequence
  targeting sequence with TTCN PAM
ccaucuccuggaagcuuucu

SEQ ID NO: 21980 - RNA, 20 nt, Artificial Sequence
  targeting sequence with TTCN PAM
agaccucucagggcucagau

SEQ ID NO: 21981 - RNA, 20 nt, Artificial Sequence
  targeting sequence with TTCN PAM
uuuccagaccucucagggcu

SEQ ID NO: 21982 - RNA, 20 nt, Artificial Sequence
  targeting sequence with TTCN PAM
cugcuccacucuuccuuucc

SEQ ID NO: 21983 - RNA, 20 nt, Artificial Sequence
  targeting sequence with TTCN PAM
aacaaagggaaagguggggg

SEQ ID NO: 21984 - RNA, 20 nt, Artificial Sequence
  targeting sequence with TTCN PAM
cuuuguuugaaaagcuuccc

SEQ ID NO: 21985 - RNA, 20 nt, Artificial Sequence
  targeting sequence with TTCN PAM
uacccccaccuuucccuuug

SEQ ID NO: 21986 - RNA, 20 nt, Artificial Sequence
  targeting sequence with TTCN PAM
cagcaccagcuccucaccau

SEQ ID NO: 21987 - RNA, 20 nt, Artificial Sequence
  targeting sequence with TTCN PAM
cuguauuuucucagcaccag

SEQ ID NO: 21988 - RNA, 20 nt, Artificial Sequence
  targeting sequence with TTCN PAM
uuauuuuuggagcacaucuc

SEQ ID NO: 21989 - RNA, 20 nt, Artificial Sequence
  targeting sequence with TTCN PAM
guuuagauguccugcccagc

SEQ ID NO: 21990 - RNA, 20 nt, Artificial Sequence
  targeting sequence with TTCN PAM
aggucaccugcuccguagcc

SEQ ID NO: 21991 - RNA, 20 nt, Artificial Sequence
  targeting sequence with TTCN PAM
accaugccaucucuccucau

SEQ ID NO: 21992 - RNA, 20 nt, Artificial Sequence
  targeting sequence with TTCN PAM
aagugcuuaucuuuuccacc

SEQ ID NO: 21993 - RNA, 20 nt, Artificial Sequence
  targeting sequence with TTCN PAM
uucaauucuaaagcuaaaaa

SEQ ID NO: 21994 - RNA, 20 nt, Artificial Sequence
  targeting sequence with TTCN PAM
auucuaaagcuaaaaaaugg

SEQ ID NO: 21995 - RNA, 20 nt, Artificial Sequence
  targeting sequence with TTCN PAM
aaagcuaaaaaaugggacug

SEQ ID NO: 21996 - RNA, 20 nt, Artificial Sequence
  targeting sequence with TTCN PAM
agucccauuuuuuagcuuua

SEQ ID NO: 21997 - RNA, 20 nt, Artificial Sequence
  targeting sequence with TTCN PAM
aagacagacaaaagccccaa

SEQ ID NO: 21998 - RNA, 20 nt, Artificial Sequence
  targeting sequence with TTCN PAM
ccauuuggggcuuuugucug

SEQ ID NO: 21999 - RNA, 20 nt, Artificial Sequence
  targeting sequence with TTCN PAM
agcuccacauuugggaacca

SEQ ID NO: 22000 - RNA, 20 nt, Artificial Sequence
  targeting sequence with TTCN PAM
caaauguggagcuugaagua

SEQ ID NO: 22001 - RNA, 20 nt, Artificial Sequence
  targeting sequence with TTCN PAM
cuucccugcccaggaagcca

SEQ ID NO: 22002 - RNA, 20 nt, Artificial Sequence
  targeting sequence with TTCN PAM
cugcccaggaagccaggaga

SEQ ID NO: 22003 - RNA, 20 nt, Artificial Sequence
  targeting sequence with TTCN PAM
ugggcagggaagagaaauca

SEQ ID NO: 22004 - RNA, 20 nt, Artificial Sequence
  targeting sequence with TTCN PAM
guggccugcaucucuccugg

SEQ ID NO: 22005 - RNA, 20 nt, Artificial Sequence
  targeting sequence with TTCN PAM
uuguuaaagaugucauggcc

SEQ ID NO: 22006 - RNA, 20 nt, Artificial Sequence
  targeting sequence with TTCN PAM
caggccugcacgcacauaug

SEQ ID NO: 22007 - RNA, 20 nt, Artificial Sequence
  targeting sequence with TTCN PAM
ugccacauguaugcacgcgu

SEQ ID NO: 22008 - RNA, 20 nt, Artificial Sequence
  targeting sequence with TTCN PAM
gugccccuuccugccacaug

SEQ ID NO: 22009 - RNA, 20 nt, Artificial Sequence
  targeting sequence with TTCN PAM
cccuggcuacagcccaggag

SEQ ID NO: 22010 - RNA, 20 nt, Artificial Sequence
  targeting sequence with TTCN PAM
uagguuuauaaaaggcuuuu

SEQ ID NO: 22011 - RNA, 20 nt, Artificial Sequence
  targeting sequence with TTCN PAM
cuuucuuagguuuauaaaag

SEQ ID NO: 22012 - RNA, 20 nt, Artificial Sequence
  targeting sequence with TTCN PAM
uaacgacuucucuuucuuag

SEQ ID NO: 22013 - RNA, 20 nt, Artificial Sequence
  targeting sequence with TTCN PAM
ugggcacucacagcaaggca

SEQ ID NO: 22014 - RNA, 20 nt, Artificial Sequence
  targeting sequence with TTCN PAM
agaggcuuccaggguaacuu

SEQ ID NO: 22015 - RNA, 20 nt, Artificial Sequence
  targeting sequence with TTCN PAM
aggguaacuuggagcaaauc

SEQ ID NO: 22016 - RNA, 20 nt, Artificial Sequence
  targeting sequence with TTCN PAM
uggacucagucccuggaaga

SEQ ID NO: 22017 - RNA, 20 nt, Artificial Sequence
  targeting sequence with TTCN PAM
agggacugaguccaagaaag

SEQ ID NO: 22018 - RNA, 20 nt, Artificial Sequence
  targeting sequence with TTCN PAM
uccagggacugaguccaaga

SEQ ID NO: 22019 - RNA, 20 nt, Artificial Sequence
  targeting sequence with TTCN PAM
agaccgcuuccucccacgaa

SEQ ID NO: 22020 - RNA, 20 nt, Artificial Sequence
  targeting sequence with TTCN PAM
ucccacgaacucauucauug

SEQ ID NO: 22021 - RNA, 20 nt, Artificial Sequence
  targeting sequence with TTCN PAM
ugggaggaagcggucuggaa

SEQ ID NO: 22022 - RNA, 20 nt, Artificial Sequence
  targeting sequence with TTCN PAM
uugugucagcaaacguagac

SEQ ID NO: 22023 - RNA, 20 nt, Artificial Sequence
  targeting sequence with TTCN PAM
gcugagggaggccgauacaa

SEQ ID NO: 22024 - RNA, 20 nt, Artificial Sequence
  targeting sequence with TTCN PAM
cacagcaaagccgugcacag

SEQ ID NO: 22025 - RNA, 20 nt, Artificial Sequence
  targeting sequence with TTCN PAM
ucugcccuuuguccagaucg

SEQ ID NO: 22026 - RNA, 20 nt, Artificial Sequence
  targeting sequence with TTCN PAM
ccuggggugggggcuugagg

SEQ ID NO: 22027 - RNA, 20 nt, Artificial Sequence
  targeting sequence with TTCN PAM
gcagaguccucccaagcccc

SEQ ID NO: 22028 - RNA, 20 nt, Artificial Sequence
  targeting sequence with TTCN PAM
acagggccuugaaagccaaa

SEQ ID NO: 22029 - RNA, 20 nt, Artificial Sequence
  targeting sequence with TTCN PAM
aggcccuguugaaaugucac

SEQ ID NO: 22030 - RNA, 20 nt, Artificial Sequence
  targeting sequence with TTCN PAM
agaggcagaguggggagggg

SEQ ID NO: 22031 - RNA, 20 nt, Artificial Sequence
  targeting sequence with TTCN PAM
aggugagggugacauccuau

SEQ ID NO: 22032 - RNA, 20 nt, Artificial Sequence
  targeting sequence with TTCN PAM
caccuacaggccugccucgc

SEQ ID NO: 22033 - RNA, 20 nt, Artificial Sequence
  targeting sequence with TTCN PAM
uuccauggcucugaaaacag

SEQ ID NO: 22034 - RNA, 20 nt, Artificial Sequence
  targeting sequence with TTCN PAM
auggcucugaaaacagucuu

SEQ ID NO: 22035 - RNA, 20 nt, Artificial Sequence
  targeting sequence with TTCN PAM
gagccauggaaagaaccaga

SEQ ID NO: 22036 - RNA, 20 nt, Artificial Sequence
  targeting sequence with TTCN PAM
uuuuuucccuugaugaaauc

SEQ ID NO: 22037 - RNA, 20 nt, Artificial Sequence
  targeting sequence with TTCN PAM
cuugaugaaauccugcaguc

SEQ ID NO: 22038 - RNA, 20 nt, Artificial Sequence
  targeting sequence with TTCN PAM
ucaagggaaaaaaagaagac

SEQ ID NO: 22039 - RNA, 20 nt, Artificial Sequence
  targeting sequence with TTCN PAM
uauccagguacugguacaug

SEQ ID NO: 22040 - RNA, 20 nt, Artificial Sequence
  targeting sequence with TTCN PAM
aggaagccuaccagauugcu

SEQ ID NO: 22041 - RNA, 20 nt, Artificial Sequence
  targeting sequence with TTCN PAM
uugaacaguuuccuauccag

SEQ ID NO: 22042 - RNA, 20 nt, Artificial Sequence
  targeting sequence with TTCN PAM
cgccaaucagugucugugac

SEQ ID NO: 22043 - RNA, 20 nt, Artificial Sequence
  targeting sequence with TTCN PAM
auggccaguucacgccaauc

SEQ ID NO: 22044 - RNA, 20 nt, Artificial Sequence
  targeting sequence with TTCN PAM
agcgcuuccauggccaguuc

SEQ ID NO: 22045 - RNA, 20 nt, Artificial Sequence
  targeting sequence with TTCN PAM
aaaucuaaaccuucuagcgc

SEQ ID NO: 22046 - RNA, 20 nt, Artificial Sequence
  targeting sequence with TTCN PAM
uugcuguuucaaaaucuaaa

SEQ ID NO: 22047 - RNA, 20 nt, Artificial Sequence
  targeting sequence with TTCN PAM
uaagggaccccacaaggacc

SEQ ID NO: 22048 - RNA, 20 nt, Artificial Sequence
  targeting sequence with TTCN PAM
uggacuugauucguuguguc

SEQ ID NO: 22049 - RNA, 20 nt, Artificial Sequence
  targeting sequence with TTCN PAM
uuguguccuuuccuggccua

SEQ ID NO: 22050 - RNA, 20 nt, Artificial Sequence
  targeting sequence with TTCN PAM
uggccuagucuaugaaagcu

SEQ ID NO: 22051 - RNA, 20 nt, Artificial Sequence
  targeting sequence with TTCN PAM
uagacuaggccaggaaagga

SEQ ID NO: 22052 - RNA, 20 nt, Artificial Sequence
  targeting sequence with TTCN PAM
gccaucucucuagcuuucau

SEQ ID NO: 22053 - RNA, 20 nt, Artificial Sequence
  targeting sequence with TTCN PAM
agauggaaacacagcucagg

SEQ ID NO: 22054 - RNA, 20 nt, Artificial Sequence
  targeting sequence with TTCN PAM
uccaucugagguucuagaug

SEQ ID NO: 22055 - RNA, 20 nt, Artificial Sequence
  targeting sequence with TTCN PAM
uuccuccaucugagguucua

SEQ ID NO: 22056 - RNA, 20 nt, Artificial Sequence
  targeting sequence with TTCN PAM
aaccuccacuccccuacccc

SEQ ID NO: 22057 - RNA, 20 nt, Artificial Sequence
  targeting sequence with TTCN PAM
cucuuuaucuccccacaguc

SEQ ID NO: 22058 - RNA, 20 nt, Artificial Sequence
  targeting sequence with TTCN PAM
cgggcugacauugaaggagu

SEQ ID NO: 22059 - RNA, 20 nt, Artificial Sequence
  targeting sequence with TTCN PAM
augucagcccgggaauaugg

SEQ ID NO: 22060 - RNA, 20 nt, Artificial Sequence
  targeting sequence with TTCN PAM
ugccuacaagucuugaucua

SEQ ID NO: 22061 - RNA, 20 nt, Artificial Sequence
  targeting sequence with TTCN PAM
uaguccuggucugguccagu

SEQ ID NO: 22062 - RNA, 20 nt, Artificial Sequence
  targeting sequence with TTCN PAM
cagccaggcuucuuaguccu

SEQ ID NO: 22063 - RNA, 20 nt, Artificial Sequence
  targeting sequence with TTCN PAM
uuggagccccaguccuccca

SEQ ID NO: 22064 - RNA, 20 nt, Artificial Sequence
  targeting sequence with TTCN PAM
gaaauggggguggugagaau

SEQ ID NO: 22065 - RNA, 20 nt, Artificial Sequence
  targeting sequence with TTCN PAM
gaacugggaggacuggggcu

SEQ ID NO: 22066 - RNA, 20 nt, Artificial Sequence
  targeting sequence with TTCN PAM
ccuuuacaacaucucaguua

SEQ ID NO: 22067 - RNA, 20 nt, Artificial Sequence
  targeting sequence with TTCN PAM
cuuguuuaguaauggcuagc

SEQ ID NO: 22068 - RNA, 20 nt, Artificial Sequence
  targeting sequence with TTCN PAM
uacacugaggacaucuaaaa

SEQ ID NO: 22069 - RNA, 20 nt, Artificial Sequence
  targeting sequence with TTCN PAM
uacagccuccuccaucucca

SEQ ID NO: 22070 - RNA, 20 nt, Artificial Sequence
  targeting sequence with TTCN PAM
gaggaggggccaggcgcggu

SEQ ID NO: 22071 - RNA, 20 nt, Artificial Sequence
  targeting sequence with TTCN PAM
uuuuuuuuuuuuuuuuuaag

SEQ ID NO: 22072 - RNA, 20 nt, Artificial Sequence
  targeting sequence with TTCN PAM
gaggagggaggaggcaucuc

SEQ ID NO: 22073 - RNA, 20 nt, Artificial Sequence
  targeting sequence with TTCN PAM
cucuccugccccacccagaa

SEQ ID NO: 22074 - RNA, 20 nt, Artificial Sequence
  targeting sequence with TTCN PAM
ggguggggcaggagagggaa

SEQ ID NO: 22075 - RNA, 20 nt, Artificial Sequence
  targeting sequence with TTCN PAM
agggauuugucgucucccuc

SEQ ID NO: 22076 - RNA, 20 nt, Artificial Sequence
  targeting sequence with TTCN PAM
auucuagggauuugucgucu

SEQ ID NO: 22077 - RNA, 20 nt, Artificial Sequence
  targeting sequence with TTCN PAM
agaccugccugggcaacaca

SEQ ID NO: 22078 - RNA, 20 nt, Artificial Sequence
  targeting sequence with TTCN PAM
ugccucagccucccaaagug

SEQ ID NO: 22079 - RNA, 20 nt, Artificial Sequence
  targeting sequence with TTCN PAM
acuauaguaaaucuggcugg

SEQ ID NO: 22080 - RNA, 20 nt, Artificial Sequence
  targeting sequence with TTCN PAM
aaacagcauguuguacacaa

SEQ ID NO: 22081 - RNA, 20 nt, Artificial Sequence
  targeting sequence with TTCN PAM
auaucauguggcuuuuucaa

SEQ ID NO: 22082 - RNA, 20 nt, Artificial Sequence
  targeting sequence with TTCN PAM
ucuaaaucccgaguacccca

SEQ ID NO: 22083 - RNA, 20 nt, Artificial Sequence
  targeting sequence with TTCN PAM
uagagauggacagccauccc

SEQ ID NO: 22084 - RNA, 20 nt, Artificial Sequence
  targeting sequence with TTCN PAM
cugccaucuaguggggaugg

SEQ ID NO: 22085 - RNA, 20 nt, Artificial Sequence
  targeting sequence with TTCN PAM
ucccuauucccaggcuuccc

SEQ ID NO: 22086 - RNA, 20 nt, Artificial Sequence
  targeting sequence with TTCN PAM
caggcuucccucugcugagc

SEQ ID NO: 22087 - RNA, 20 nt, Artificial Sequence
  targeting sequence with TTCN PAM
cucugcugagcucauucagg

SEQ ID NO: 22088 - RNA, 20 nt, Artificial Sequence
  targeting sequence with TTCN PAM
ggggccuugugacucugacc

SEQ ID NO: 22089 - RNA, 20 nt, Artificial Sequence
  targeting sequence with TTCN PAM
accugacacauuuugcagcg

SEQ ID NO: 22090 - RNA, 20 nt, Artificial Sequence
  targeting sequence with TTCN PAM
uucaaccugacacauuuugc

SEQ ID NO: 22091 - RNA, 20 nt, Artificial Sequence
  targeting sequence with TTCN PAM
gaguuccuucaaccugacac

SEQ ID NO: 22092 - RNA, 20 nt, Artificial Sequence
  targeting sequence with TTCN PAM
agcuguagcucagcugugcu

SEQ ID NO: 22093 - RNA, 20 nt, Artificial Sequence
  targeting sequence with TTCN PAM
acaaagaagaugguuggagc

SEQ ID NO: 22094 - RNA, 20 nt, Artificial Sequence
  targeting sequence with TTCN PAM
uuguggaaaggggccugcua

SEQ ID NO: 22095 - RNA, 20 nt, Artificial Sequence
  targeting sequence with TTCN PAM
gggcuccaaccaucuucuuu

SEQ ID NO: 22096 - RNA, 20 nt, Artificial Sequence
  targeting sequence with TTCN PAM
cugcuucugggcuccaacca

SEQ ID NO: 22097 - RNA, 20 nt, Artificial Sequence
  targeting sequence with TTCN PAM
aggucugaguccucgcucug

SEQ ID NO: 22098 - RNA, 20 nt, Artificial Sequence
  targeting sequence with TTCN PAM
cucuuggccacugugcuggg

SEQ ID NO: 22099 - RNA, 20 nt, Artificial Sequence
  targeting sequence with TTCN PAM
uuaaagcgccuugagagggc

SEQ ID NO: 22100 - RNA, 20 nt, Artificial Sequence
  targeting sequence with TTCN PAM
uuggcccaugugaugcccgc

SEQ ID NO: 22101 - RNA, 20 nt, Artificial Sequence
  targeting sequence with TTCN PAM
acgaauuccucuucacaaac

SEQ ID NO: 22102 - RNA, 20 nt, Artificial Sequence
  targeting sequence with TTCN PAM
uagaaaagggcaaugcgggc

SEQ ID NO: 22103 - RNA, 20 nt, Artificial Sequence
  targeting sequence with TTCN PAM
ucuucacaaacacuuguuug

SEQ ID NO: 22104 - RNA, 20 nt, Artificial Sequence
  targeting sequence with TTCN PAM
caaacacuuguuugccaggu

SEQ ID NO: 22105 - RNA, 20 nt, Artificial Sequence
  targeting sequence with TTCN PAM
gacucugaugccucccuuaa

SEQ ID NO: 22106 - RNA, 20 nt, Artificial Sequence
  targeting sequence with TTCN PAM
uccguguucuccaggcaugu

SEQ ID NO: 22107 - RNA, 20 nt, Artificial Sequence
  targeting sequence with TTCN PAM
ccaggcaugugguucguagu

SEQ ID NO: 22108 - RNA, 20 nt, Artificial Sequence
  targeting sequence with TTCN PAM
uaguuggagagcucuuagcu

SEQ ID NO: 22109 - RNA, 20 nt, Artificial Sequence
  targeting sequence with TTCN PAM
cuguuagaauguggaccucu

SEQ ID NO: 22110 - RNA, 20 nt, Artificial Sequence
  targeting sequence with TTCN PAM
aacagggaaagcuggucaau

SEQ ID NO: 22111 - RNA, 20 nt, Artificial Sequence
  targeting sequence with TTCN PAM
gagguccacauucuaacagg

SEQ ID NO: 22112 - RNA, 20 nt, Artificial Sequence
  targeting sequence with TTCN PAM
cccuggguccucagucucuu

SEQ ID NO: 22113 - RNA, 20 nt, Artificial Sequence
  targeting sequence with TTCN PAM
ugucaagagacugaggaccc

SEQ ID NO: 22114 - RNA, 20 nt, Artificial Sequence
  targeting sequence with TTCN PAM
ucccacaggaccaggcuucc

SEQ ID NO: 22115 - RNA, 20 nt, Artificial Sequence
  targeting sequence with TTCN PAM
ggagggaggaugccaugcug

SEQ ID NO: 22116 - RNA, 20 nt, Artificial Sequence
  targeting sequence with TTCN PAM
guucaaagggcucuggagcu

SEQ ID NO: 22117 - RNA, 20 nt, Artificial Sequence
  targeting sequence with TTCN PAM
aagggcucuggagcugcugc

SEQ ID NO: 22118 - RNA, 20 nt, Artificial Sequence
  targeting sequence with TTCN PAM
aaaugggcugaccugugccu

SEQ ID NO: 22119 - RNA, 20 nt, Artificial Sequence
  targeting sequence with TTCN PAM
gguggcuuugcugucaccau

SEQ ID NO: 22120 - RNA, 20 nt, Artificial Sequence
  targeting sequence with TTCN PAM
gcccaggguuuggaggagca

SEQ ID NO: 22121 - RNA, 20 nt, Artificial Sequence
  targeting sequence with TTCN PAM
gauucugcccaggguuugga

SEQ ID NO: 22122 - RNA, 20 nt, Artificial Sequence
  targeting sequence with TTCN PAM
ucagaaacuucuagaggucc

SEQ ID NO: 22123 - RNA, 20 nt, Artificial Sequence
  targeting sequence with TTCN PAM
gaggaacaagcagacuggug

SEQ ID NO: 22124 - RNA, 20 nt, Artificial Sequence
  targeting sequence with TTCN PAM
agagguccaugaguuaaagu

SEQ ID NO: 22125 - RNA, 20 nt, Artificial Sequence
  targeting sequence with TTCN PAM
aggcaagggcugcaauuuua

SEQ ID NO: 22126 - RNA, 20 nt, Artificial Sequence
  targeting sequence with TTCN PAM
acagacuuggugggauucau

SEQ ID NO: 22127 - RNA, 20 nt, Artificial Sequence
  targeting sequence with TTCN PAM
uucccuaccccuccaccuuc

SEQ ID NO: 22128 - RNA, 20 nt, Artificial Sequence
  targeting sequence with TTCN PAM
cuaccccuccaccuucuucc

SEQ ID NO: 22129 - RNA, 20 nt, Artificial Sequence
  targeting sequence with TTCN PAM
uccagaaucugucuuuauac

SEQ ID NO: 22130 - RNA, 20 nt, Artificial Sequence
  targeting sequence with TTCN PAM
agaaucugucuuuauacccu

SEQ ID NO: 22131 - RNA, 20 nt, Artificial Sequence
  targeting sequence with TTCN PAM
ggaagaagguggagggguag

SEQ ID NO: 22132 - RNA, 20 nt, Artificial Sequence
  targeting sequence with TTCN PAM
ccuccucugcucccucugug

SEQ ID NO: 22133 - RNA, 20 nt, Artificial Sequence
  targeting sequence with TTCN PAM
acccauguugccaagaugua

SEQ ID NO: 22134 - RNA, 20 nt, Artificial Sequence
  targeting sequence with TTCN PAM
ucuuugggucuagagucucc

SEQ ID NO: 22135 - RNA, 20 nt, Artificial Sequence
  targeting sequence with TTCN PAM
uugggucuagagucucccaa

SEQ ID NO: 22136 - RNA, 20 nt, Artificial Sequence
  targeting sequence with TTCN PAM
uuacaugguccaaucccaug

SEQ ID NO: 22137 - RNA, 20 nt, Artificial Sequence
  targeting sequence with TTCN PAM
ucuccucuguggcucacugu

SEQ ID NO: 22138 - RNA, 20 nt, Artificial Sequence
  targeting sequence with TTCN PAM
caccccuagccaaucaccca

SEQ ID NO: 22139 - RNA, 20 nt, Artificial Sequence
  targeting sequence with TTCN PAM
aaagugggugauuggcuagg

SEQ ID NO: 22140 - RNA, 20 nt, Artificial Sequence
  targeting sequence with TTCN PAM
uggcuucaaaagugggugau

SEQ ID NO: 22141 - RNA, 20 nt, Artificial Sequence
  targeting sequence with TTCN PAM
uuauuucuucgccacaggcc

SEQ ID NO: 22142 - RNA, 20 nt, Artificial Sequence
  targeting sequence with TTCN PAM
ucgccacaggccuucaucag

SEQ ID NO: 22143 - RNA, 20 nt, Artificial Sequence
  targeting sequence with TTCN PAM
ccacaggccuucaucagagu

SEQ ID NO: 22144 - RNA, 20 nt, Artificial Sequence
  targeting sequence with TTCN PAM
ucagaguacaagaccuccga

SEQ ID NO: 22145 - RNA, 20 nt, Artificial Sequence
  targeting sequence with TTCN PAM
ucuuuuaccucaaugcugcu

SEQ ID NO: 22146 - RNA, 20 nt, Artificial Sequence
  targeting sequence with TTCN PAM
uucucaagaaggcauacuug

SEQ ID NO: 22147 - RNA, 20 nt, Artificial Sequence
  targeting sequence with TTCN PAM
caagaaggcauacuuggggu

SEQ ID NO: 22148 - RNA, 20 nt, Artificial Sequence
  targeting sequence with TTCN PAM
ugagaaggaaaaaugcuuca

SEQ ID NO: 22149 - RNA, 20 nt, Artificial Sequence
  targeting sequence with TTCN PAM
uguuuuaggggcagcccuuc

SEQ ID NO: 22150 - RNA, 20 nt, Artificial Sequence
  targeting sequence with TTCN PAM
aacaggcaagagccuugagg

SEQ ID NO: 22151 - RNA, 20 nt, Artificial Sequence
  targeting sequence with TTCN PAM
cauguccucaaggcucuugc

SEQ ID NO: 22152 - RNA, 20 nt, Artificial Sequence
  targeting sequence with TTCN PAM
ggaucucuccaggguugggu

SEQ ID NO: 22153 - RNA, 20 nt, Artificial Sequence
  targeting sequence with TTCN PAM
agucugugaaaagggauugg

SEQ ID NO: 22154 - RNA, 20 nt, Artificial Sequence
  targeting sequence with TTCN PAM
cagacuagaaacccaacccu

SEQ ID NO: 22155 - RNA, 20 nt, Artificial Sequence
  targeting sequence with TTCN PAM
caaaugcacaugagcugagc

SEQ ID NO: 22156 - RNA, 20 nt, Artificial Sequence
  targeting sequence with TTCN PAM
ccagaaauggaccuggggag

SEQ ID NO: 22157 - RNA, 20 nt, Artificial Sequence
  targeting sequence with TTCN PAM
ggggaauggagcucagcuca

SEQ ID NO: 22158 - RNA, 20 nt, Artificial Sequence
  targeting sequence with TTCN PAM
gacugugggccuugcucccc

SEQ ID NO: 22159 - RNA, 20 nt, Artificial Sequence
  targeting sequence with TTCN PAM
ggagcaaccccuagcccuac

SEQ ID NO: 22160 - RNA, 20 nt, Artificial Sequence
  targeting sequence with TTCN PAM
ggcugagaauauugaccuug

SEQ ID NO: 22161 - RNA, 20 nt, Artificial Sequence
  targeting sequence with TTCN PAM
cagccagaaacaguagggcu

SEQ ID NO: 22162 - RNA, 20 nt, Artificial Sequence
  targeting sequence with TTCN PAM
uuagcacacugcaggccuau

SEQ ID NO: 22163 - RNA, 20 nt, Artificial Sequence
  targeting sequence with TTCN PAM
uuuuuuuuuuuuuuuuucug

SEQ ID NO: 22164 - RNA, 20 nt, Artificial Sequence
  targeting sequence with TTCN PAM
uaauuucuguguaucucagu

SEQ ID NO: 22165 - RNA, 20 nt, Artificial Sequence
  targeting sequence with TTCN PAM
guguaucucagugcugucug

SEQ ID NO: 22166 - RNA, 20 nt, Artificial Sequence
  targeting sequence with TTCN PAM
ccugaacauauuuauuguga

SEQ ID NO: 22167 - RNA, 20 nt, Artificial Sequence
  targeting sequence with TTCN PAM
ggagaaaaaauguauaugcc

SEQ ID NO: 22168 - RNA, 20 nt, Artificial Sequence
  targeting sequence with TTCN PAM
caauaaauauguucaggaga

SEQ ID NO: 22169 - RNA, 20 nt, Artificial Sequence
  targeting sequence with TTCN PAM
cauaccuucacaauaaauau

SEQ ID NO: 22170 - RNA, 20 nt, Artificial Sequence
  targeting sequence with TTCN PAM
aauguaucucacauucccau

SEQ ID NO: 22171 - RNA, 20 nt, Artificial Sequence
  targeting sequence with TTCN PAM
caguuggaaacagugaggaa

SEQ ID NO: 22172 - RNA, 20 nt, Artificial Sequence
  targeting sequence with TTCN PAM
aacugggaauucaaauguau

SEQ ID NO: 22173 - RNA, 20 nt, Artificial Sequence
  targeting sequence with TTCN PAM
ucacuguuuccaacugggaa

SEQ ID NO: 22174 - RNA, 20 nt, Artificial Sequence
  targeting sequence with TTCN PAM
uuuccccauaauaaacaccu

SEQ ID NO: 22175 - RNA, 20 nt, Artificial Sequence
  targeting sequence with TTCN PAM
ccauaauaaacaccugucau

SEQ ID NO: 22176 - RNA, 20 nt, Artificial Sequence
  targeting sequence with TTCN PAM
augcaggaggaaauuaaggc

SEQ ID NO: 22177 - RNA, 20 nt, Artificial Sequence
  targeting sequence with TTCN PAM
uccugcauggaauagggaga

SEQ ID NO: 22178 - RNA, 20 nt, Artificial Sequence
  targeting sequence with TTCN PAM
accaaguuuuuggcuaugga

SEQ ID NO: 22179 - RNA, 20 nt, Artificial Sequence
  targeting sequence with TTCN PAM
agcccagucuauuuccuaag

SEQ ID NO: 22180 - RNA, 20 nt, Artificial Sequence
  targeting sequence with TTCN PAM
uaagcucaugcucucucggc

SEQ ID NO: 22181 - RNA, 20 nt, Artificial Sequence
  targeting sequence with TTCN PAM
gggguuuaccuacccgcgug

SEQ ID NO: 22182 - RNA, 20 nt, Artificial Sequence
  targeting sequence with TTCN PAM
gagcuauugcucaaaaugcc

SEQ ID NO: 22183 - RNA, 20 nt, Artificial Sequence
  targeting sequence with TTCN PAM
cuuguaaauccacuggccug

SEQ ID NO: 22184 - RNA, 20 nt, Artificial Sequence
  targeting sequence with TTCN PAM
ccugaagccaaggagcauaa

SEQ ID NO: 22185 - RNA, 20 nt, Artificial Sequence
  targeting sequence with TTCN PAM
ggugaagacccccagaucca

SEQ ID NO: 22186 - RNA, 20 nt, Artificial Sequence
  targeting sequence with TTCN PAM
ucucuacaaaaguaacugcu

SEQ ID NO: 22187 - RNA, 20 nt, Artificial Sequence
  targeting sequence with TTCN PAM
cagcucauagcauacgagga

SEQ ID NO: 22188 - RNA, 20 nt, Artificial Sequence
  targeting sequence with TTCN PAM
agagacaaucuuaggaguuu

SEQ ID NO: 22189 - RNA, 20 nt, Artificial Sequence
  targeting sequence with TTCN PAM
agagaacugcagauccuuag

SEQ ID NO: 22190 - RNA, 20 nt, Artificial Sequence
  targeting sequence with TTCN PAM
cuggaauuaugcugagcacc

SEQ ID NO: 22191 - RNA, 20 nt, Artificial Sequence
  targeting sequence with TTCN PAM
uguccugcugacggggggaa

SEQ ID NO: 22192 - RNA, 20 nt, Artificial Sequence
  targeting sequence with TTCN PAM
ccccgucagcaggacaagaa

SEQ ID NO: 22193 - RNA, 20 nt, Artificial Sequence
  targeting sequence with TTCN PAM
uuccccccgucagcaggaca

SEQ ID NO: 22194 - RNA, 20 nt, Artificial Sequence
  targeting sequence with TTCN PAM
aggccccaggauaucaccau

SEQ ID NO: 22195 - RNA, 20 nt, Artificial Sequence
  targeting sequence with TTCN PAM
ggccauauccauucuaggcc

SEQ ID NO: 22196 - RNA, 20 nt, Artificial Sequence
  targeting sequence with TTCN PAM
ugucuaguaaaaccuuuuuu

SEQ ID NO: 22197 - RNA, 20 nt, Artificial Sequence
  targeting sequence with TTCN PAM
auucauuuccaacuauuagg

SEQ ID NO: 22198 - RNA, 20 nt, Artificial Sequence
  targeting sequence with TTCN PAM
uuuccaacuauuaggaguua

SEQ ID NO: 22199 - RNA, 20 nt, Artificial Sequence
  targeting sequence with TTCN PAM
aacuauuaggaguuaguuug

SEQ ID NO: 22200 - RNA, 20 nt, Artificial Sequence
  targeting sequence with TTCN PAM
aaaaaccugcacacagcuca

SEQ ID NO: 22201 - RNA, 20 nt, Artificial Sequence
  targeting sequence with TTCN PAM
gucaguauggaagcauguug

SEQ ID NO: 22202 - RNA, 20 nt, Artificial Sequence
  targeting sequence with TTCN PAM
auacugacagaaauuaucau

SEQ ID NO: 22203 - RNA, 20 nt, Artificial Sequence
  targeting sequence with TTCN PAM
ccagcuugucuaagaguuug

SEQ ID NO: 22204 - RNA, 20 nt, Artificial Sequence
  targeting sequence with TTCN PAM
augucuuaucguccuccaau

SEQ ID NO: 22205 - RNA, 20 nt, Artificial Sequence
  targeting sequence with TTCN PAM
agaaaacaagcaaaaggaaa

SEQ ID NO: 22206 - RNA, 20 nt, Artificial Sequence
  targeting sequence with TTCN PAM
agaaagagcagcauauugga

SEQ ID NO: 22207 - RNA, 20 nt, Artificial Sequence
  targeting sequence with TTCN PAM
uuuugcuuguuuucuagaaa

SEQ ID NO: 22208 - RNA, 20 nt, Artificial Sequence
  targeting sequence with TTCN PAM
cuugucuacagcucgaguau

SEQ ID NO: 22209 - RNA, 20 nt, Artificial Sequence
  targeting sequence with TTCN PAM
cugacacagaaggaagaagc

SEQ ID NO: 22210 - RNA, 20 nt, Artificial Sequence
  targeting sequence with TTCN PAM
gugucagggaacauucgcuu

SEQ ID NO: 22211 - RNA, 20 nt, Artificial Sequence
  targeting sequence with TTCN PAM
uucugugucagggaacauuc

SEQ ID NO: 22212 - RNA, 20 nt, Artificial Sequence
  targeting sequence with TTCN PAM
uccuucugugucagggaaca

SEQ ID NO: 22213 - RNA, 20 nt, Artificial Sequence
  targeting sequence with TTCN PAM
aaagacuacauugugugaua

SEQ ID NO: 22214 - RNA, 20 nt, Artificial Sequence
  targeting sequence with TTCN PAM
uuguaucacacaauguaguc

SEQ ID NO: 22215 - RNA, 20 nt, Artificial Sequence
  targeting sequence with TTCN PAM
gucugacuccagauauuccu

SEQ ID NO: 22216 - RNA, 20 nt, Artificial Sequence
  targeting sequence with TTCN PAM
agcucugucugacccugacc

SEQ ID NO: 22217 - RNA, 20 nt, Artificial Sequence
  targeting sequence with TTCN PAM
ucuucuugagucucagcguc

SEQ ID NO: 22218 - RNA, 20 nt, Artificial Sequence
  targeting sequence with TTCN PAM
ugagucucagcguccuucac

SEQ ID NO: 22219 - RNA, 20 nt, Artificial Sequence
  targeting sequence with TTCN PAM
cucuaacacuuggguaguga

SEQ ID NO: 22220 - RNA, 20 nt, Artificial Sequence
  targeting sequence with TTCN PAM
ucucagugacccucagggua

SEQ ID NO: 22221 - RNA, 20 nt, Artificial Sequence
  targeting sequence with TTCN PAM
ggguauauacuuuauacaca

SEQ ID NO: 22222 - RNA, 20 nt, Artificial Sequence
  targeting sequence with TTCN PAM
gcaugcgggauuucuuaccu

SEQ ID NO: 22223 - RNA, 20 nt, Artificial Sequence
  targeting sequence with TTCN PAM
uaccuucucuuuagaaguag

SEQ ID NO: 22224 - RNA, 20 nt, Artificial Sequence
  targeting sequence with TTCN PAM
cuuuagaaguagggauaucg

SEQ ID NO: 22225 - RNA, 20 nt, Artificial Sequence
  targeting sequence with TTCN PAM
aaagagaagguaagaaaucc

SEQ ID NO: 22226 - RNA, 20 nt, Artificial Sequence
  targeting sequence with TTCN PAM
gcccaagagggagaccaaua

SEQ ID NO: 22227 - RNA, 20 nt, Artificial Sequence
  targeting sequence with TTCN PAM
ccugcucugucauccccaug

SEQ ID NO: 22228 - RNA, 20 nt, Artificial Sequence
  targeting sequence with TTCN PAM
aacuauuccgucauagccuu

SEQ ID NO: 22229 - RNA, 20 nt, Artificial Sequence
  targeting sequence with TTCN PAM
gucauagccuuggaauacac

SEQ ID NO: 22230 - RNA, 20 nt, Artificial Sequence
  targeting sequence with TTCN PAM
aaggcuaugacggaauaguu

SEQ ID NO: 22231 - RNA, 20 nt, Artificial Sequence
  targeting sequence with TTCN PAM
uguguauuccaaggcuauga

SEQ ID NO: 22232 - RNA, 20 nt, Artificial Sequence
  targeting sequence with TTCN PAM
ucaggguugcuuuccugugu

SEQ ID NO: 22233 - RNA, 20 nt, Artificial Sequence
  targeting sequence with TTCN PAM
auuaaacaaacaaagguuug

SEQ ID NO: 22234 - RNA, 20 nt, Artificial Sequence
  targeting sequence with TTCN PAM
cagcgggaaccuaggggaga

SEQ ID NO: 22235 - RNA, 20 nt, Artificial Sequence
  targeting sequence with TTCN PAM
cgcugggaaggcuugacaac

SEQ ID NO: 22236 - RNA, 20 nt, Artificial Sequence
  targeting sequence with TTCN PAM
aguaggaaggcccaggggcc

SEQ ID NO: 22237 - RNA, 20 nt, Artificial Sequence
  targeting sequence with TTCN PAM
uacuggaaccugggcuuggc

SEQ ID NO: 22238 - RNA, 20 nt, Artificial Sequence
  targeting sequence with TTCN PAM
agugaggccccugggccuuc

SEQ ID NO: 22239 - RNA, 20 nt, Artificial Sequence
  targeting sequence with TTCN PAM
ugcccauggcugcagaggcc

SEQ ID NO: 22240 - RNA, 20 nt, Artificial Sequence
  targeting sequence with TTCN PAM
uuugcuucuaauuuuuccag

SEQ ID NO: 22241 - RNA, 20 nt, Artificial Sequence
  targeting sequence with TTCN PAM
aauuuuuccaggagaggaag

SEQ ID NO: 22242 - RNA, 20 nt, Artificial Sequence
  targeting sequence with TTCN PAM
aggagaggaagaagcgggga

SEQ ID NO: 22243 - RNA, 20 nt, Artificial Sequence
  targeting sequence with TTCN PAM
ucuccuggaaaaauuagaag

SEQ ID NO: 22244 - RNA, 20 nt, Artificial Sequence
  targeting sequence with TTCN PAM
uccucuccuggaaaaauuag

SEQ ID NO: 22245 - RNA, 20 nt, Artificial Sequence
  targeting sequence with TTCN PAM
ggcagauguguuuuccuacc

SEQ ID NO: 22246 - RNA, 20 nt, Artificial Sequence
  targeting sequence with TTCN PAM
uaccaggggaaguuccauga

SEQ ID NO: 22247 - RNA, 20 nt, Artificial Sequence
  targeting sequence with TTCN PAM
ccugguaggaaaacacaucu

SEQ ID NO: 22248 - RNA, 20 nt, Artificial Sequence
  targeting sequence with TTCN PAM
augaggccgccaaacuguac

SEQ ID NO: 22249 - RNA, 20 nt, Artificial Sequence
  targeting sequence with TTCN PAM
cgugcccacuccucuuguac

SEQ ID NO: 22250 - RNA, 20 nt, Artificial Sequence
  targeting sequence with TTCN PAM
agcgcgagguucucgugccc

SEQ ID NO: 22251 - RNA, 20 nt, Artificial Sequence
  targeting sequence with TTCN PAM
cacgugcgguguccaaguua

SEQ ID NO: 22252 - RNA, 20 nt, Artificial Sequence
  targeting sequence with TTCN PAM
ccaagagugcugcggacaaa

SEQ ID NO: 22253 - RNA, 20 nt, Artificial Sequence
  targeting sequence with TTCN PAM
gagaccauugcuaguuuuug

SEQ ID NO: 22254 - RNA, 20 nt, Artificial Sequence
  targeting sequence with TTCN PAM
ccacauccuuucugagacca

SEQ ID NO: 22255 - RNA, 20 nt, Artificial Sequence
  targeting sequence with TTCN PAM
accaguggcuguagaugggu

SEQ ID NO: 22256 - RNA, 20 nt, Artificial Sequence
  targeting sequence with TTCN PAM
gaccuucaucagugacaggg

SEQ ID NO: 22257 - RNA, 20 nt, Artificial Sequence
  targeting sequence with TTCN PAM
ucagugacagggcuggaugg

SEQ ID NO: 22258 - RNA, 20 nt, Artificial Sequence
  targeting sequence with TTCN PAM
uugaguugagggcucagggc

SEQ ID NO: 22259 - RNA, 20 nt, Artificial Sequence
  targeting sequence with TTCN PAM
gggcugucccccacaaaucc

SEQ ID NO: 22260 - RNA, 20 nt, Artificial Sequence
  targeting sequence with TTCN PAM
uggcggcuccugacaaggau

SEQ ID NO: 22261 - RNA, 20 nt, Artificial Sequence
  targeting sequence with TTCN PAM
ggcaggagccgguccugccg

SEQ ID NO: 22262 - RNA, 20 nt, Artificial Sequence
  targeting sequence with TTCN PAM
cauagcaccugcugauuguc

SEQ ID NO: 22263 - RNA, 20 nt, Artificial Sequence
  targeting sequence with TTCN PAM
cacugggcuucugggaaguc

SEQ ID NO: 22264 - RNA, 20 nt, Artificial Sequence
  targeting sequence with TTCN PAM
gggaagucaggcagagccuc

SEQ ID NO: 22265 - RNA, 20 nt, Artificial Sequence
  targeting sequence with TTCN PAM
cagaagcccagugagaaguc

SEQ ID NO: 22266 - RNA, 20 nt, Artificial Sequence
  targeting sequence with TTCN PAM
cuuuugcauugggacggccc

SEQ ID NO: 22267 - RNA, 20 nt, Artificial Sequence
  targeting sequence with TTCN PAM
ugggggccgucccaaugcaa

SEQ ID NO: 22268 - RNA, 20 nt, Artificial Sequence
  targeting sequence with TTCN PAM
uggaccaggcuccugauggc

SEQ ID NO: 22269 - RNA, 20 nt, Artificial Sequence
  targeting sequence with TTCN PAM
gugggaaggaguugcacuaa

SEQ ID NO: 22270 - RNA, 20 nt, Artificial Sequence
  targeting sequence with TTCN PAM
cacagaagccaucaggagcc

SEQ ID NO: 22271 - RNA, 20 nt, Artificial Sequence
  targeting sequence with TTCN PAM
gucuaagcaagguucaaaga

SEQ ID NO: 22272 - RNA, 20 nt, Artificial Sequence
  targeting sequence with TTCN PAM
aagaggcuucgguacacugg

SEQ ID NO: 22273 - RNA, 20 nt, Artificial Sequence
  targeting sequence with TTCN PAM
guacacugggcaaugagggu

SEQ ID NO: 22274 - RNA, 20 nt, Artificial Sequence
  targeting sequence with TTCN PAM
uuccaucaaggggcuuuguu

SEQ ID NO: 22275 - RNA, 20 nt, Artificial Sequence
  targeting sequence with TTCN PAM
aucaaggggcuuuguuaacc

SEQ ID NO: 22276 - RNA, 20 nt, Artificial Sequence
  targeting sequence with TTCN PAM
ggaagugucaaaaguggcuc

SEQ ID NO: 22277 - RNA, 20 nt, Artificial Sequence
  targeting sequence with TTCN PAM
agaaaaggcagguuaacaaa

SEQ ID NO: 22278 - RNA, 20 nt, Artificial Sequence
  targeting sequence with TTCN PAM
uaacauacugagagccacuu

SEQ ID NO: 22279 - RNA, 20 nt, Artificial Sequence
  targeting sequence with TTCN PAM
ccagcucacaaguucaagau

SEQ ID NO: 22280 - RNA, 20 nt, Artificial Sequence
  targeting sequence with TTCN PAM
agauggaaaaucuuccccac

SEQ ID NO: 22281 - RNA, 20 nt, Artificial Sequence
  targeting sequence with TTCN PAM
aucuugaacuugugagcugg

SEQ ID NO: 22282 - RNA, 20 nt, Artificial Sequence
  targeting sequence with TTCN PAM
ccacuuuuuucugcuuuucu

SEQ ID NO: 22283 - RNA, 20 nt, Artificial Sequence
  targeting sequence with TTCN PAM
gcuuuucuauuccugaagau

SEQ ID NO: 22284 - RNA, 20 nt, Artificial Sequence
  targeting sequence with TTCN PAM
auuccugaagauggcugugc

SEQ ID NO: 22285 - RNA, 20 nt, Artificial Sequence
  targeting sequence with TTCN PAM
ugaagauggcugugcucuuc

SEQ ID NO: 22286 - RNA, 20 nt, Artificial Sequence
  targeting sequence with TTCN PAM
ggaauagaaaagcagaaaaa

SEQ ID NO: 22287 - RNA, 20 nt, Artificial Sequence
  targeting sequence with TTCN PAM
accaccuguucgacccuggg

SEQ ID NO: 22288 - RNA, 20 nt, Artificial Sequence
  targeting sequence with TTCN PAM
acccuggggcugaaggugug

SEQ ID NO: 22289 - RNA, 20 nt, Artificial Sequence
  targeting sequence with TTCN PAM
gccccagggucgaacaggug

SEQ ID NO: 22290 - RNA, 20 nt, Artificial Sequence
  targeting sequence with TTCN PAM
ucaggacuuggacgagcucc

SEQ ID NO: 22291 - RNA, 20 nt, Artificial Sequence
  targeting sequence with TTCN PAM
ccuuagugauuucuucacuc

SEQ ID NO: 22292 - RNA, 20 nt, Artificial Sequence
  targeting sequence with TTCN PAM
ucacuccguaccugagaccc

SEQ ID NO: 22293 - RNA, 20 nt, Artificial Sequence
  targeting sequence with TTCN PAM
cuccguaccugagacccagg

SEQ ID NO: 22294 - RNA, 20 nt, Artificial Sequence
  targeting sequence with TTCN PAM
ggcucccucuacuuuuuccu

SEQ ID NO: 22295 - RNA, 20 nt, Artificial Sequence
  targeting sequence with TTCN PAM
ucgucaccuuuccuacccuc

SEQ ID NO: 22296 - RNA, 20 nt, Artificial Sequence
  targeting sequence with TTCN PAM
uacccucccucaggccccac

SEQ ID NO: 22297 - RNA, 20 nt, Artificial Sequence
  targeting sequence with TTCN PAM
aggugucuuugguggggccu

SEQ ID NO: 22298 - RNA, 20 nt, Artificial Sequence
  targeting sequence with TTCN PAM
uaacacauucauacugagau

SEQ ID NO: 22299 - RNA, 20 nt, Artificial Sequence
  targeting sequence with TTCN PAM
uacugagaucaccagaguca

SEQ ID NO: 22300 - RNA, 20 nt, Artificial Sequence
  targeting sequence with TTCN PAM
ggggauaacaaaauuuuaac

SEQ ID NO: 22301 - RNA, 20 nt, Artificial Sequence
  targeting sequence with TTCN PAM
uccugaguuaaaauuuuguu

SEQ ID NO: 22302 - RNA, 20 nt, Artificial Sequence
  targeting sequence with TTCN PAM
accucuagggucuugauccc

SEQ ID NO: 22303 - RNA, 20 nt, Artificial Sequence
  targeting sequence with TTCN PAM
caacccuaaauucuaccucu

SEQ ID NO: 22304 - RNA, 20 nt, Artificial Sequence
  targeting sequence with TTCN PAM
acugcagcacagcugccucc

SEQ ID NO: 22305 - RNA, 20 nt, Artificial Sequence
  targeting sequence with TTCN PAM
gccucccaaagugcuaguau

SEQ ID NO: 22306 - RNA, 20 nt, Artificial Sequence
  targeting sequence with TTCN PAM
ccauauugcccaggcugguc

SEQ ID NO: 22307 - RNA, 20 nt, Artificial Sequence
  targeting sequence with TTCN PAM
accuuagccucccaguagcu

SEQ ID NO: 22308 - RNA, 20 nt, Artificial Sequence
  targeting sequence with TTCN PAM
accucuggggcucaagcaau

SEQ ID NO: 22309 - RNA, 20 nt, Artificial Sequence
  targeting sequence with TTCN PAM
agccugggugacagagcaag

SEQ ID NO: 22310 - RNA, 20 nt, Artificial Sequence
  targeting sequence with TTCN PAM
uucugugggaugaccugggg

SEQ ID NO: 22311 - RNA, 20 nt, Artificial Sequence
  targeting sequence with TTCN PAM
gugggaugaccuggggaaag

SEQ ID NO: 22312 - RNA, 20 nt, Artificial Sequence
  targeting sequence with TTCN PAM
ccaggucaucccacagaaag

SEQ ID NO: 22313 - RNA, 20 nt, Artificial Sequence
  targeting sequence with TTCN PAM
guuugccaaaccucccuucc

SEQ ID NO: 22314 - RNA, 20 nt, Artificial Sequence
  targeting sequence with TTCN PAM
cuucucagaugguaauagcg

SEQ ID NO: 22315 - RNA, 20 nt, Artificial Sequence
  targeting sequence with TTCN PAM
cagaugguaauagcgacagc

SEQ ID NO: 22316 - RNA, 20 nt, Artificial Sequence
  targeting sequence with TTCN PAM
gugcaaaucucaugacuaaa

SEQ ID NO: 22317 - RNA, 20 nt, Artificial Sequence
  targeting sequence with TTCN PAM
uauacauuauucugugcaaa

SEQ ID NO: 22318 - RNA, 20 nt, Artificial Sequence
  targeting sequence with TTCN PAM
aaugcgcuuuccuauacauu

SEQ ID NO: 22319 - RNA, 20 nt, Artificial Sequence
  targeting sequence with TTCN PAM
acagguuggcauuucuaaug

SEQ ID NO: 22320 - RNA, 20 nt, Artificial Sequence
  targeting sequence with TTCN PAM
uaaucuuucuacagguuggc

SEQ ID NO: 22321 - RNA, 20 nt, Artificial Sequence
  targeting sequence with TTCN PAM
uaccucucucccuggcuggc

SEQ ID NO: 22322 - RNA, 20 nt, Artificial Sequence
  targeting sequence with TTCN PAM
ugugcccacagccucccacc

SEQ ID NO: 22323 - RNA, 20 nt, Artificial Sequence
  targeting sequence with TTCN PAM
ggugggaggcugugggcaca

SEQ ID NO: 22324 - RNA, 20 nt, Artificial Sequence
  targeting sequence with TTCN PAM
uagagagacggagcaaaugg

SEQ ID NO: 22325 - RNA, 20 nt, Artificial Sequence
  targeting sequence with TTCN PAM
aaggagguugguuccuuuuc

SEQ ID NO: 22326 - RNA, 20 nt, Artificial Sequence
  targeting sequence with TTCN PAM
uuuucaauccccccugcccc

SEQ ID NO: 22327 - RNA, 20 nt, Artificial Sequence
  targeting sequence with TTCN PAM
auccccccugcccccaccug

SEQ ID NO: 22328 - RNA, 20 nt, Artificial Sequence
  targeting sequence with TTCN PAM
gacuaccaggugggggcagg

SEQ ID NO: 22329 - RNA, 20 nt, Artificial Sequence
  targeting sequence with TTCN PAM
caaauucagacuaccaggug

SEQ ID NO: 22330 - RNA, 20 nt, Artificial Sequence
  targeting sequence with TTCN PAM
aguaaacaaaaauaugccac

SEQ ID NO: 22331 - RNA, 20 nt, Artificial Sequence
  targeting sequence with TTCN PAM
caagauucaaucugguuuuc

SEQ ID NO: 22332 - RNA, 20 nt, Artificial Sequence
  targeting sequence with TTCN PAM
aucugguuuucagaaaauuu

SEQ ID NO: 22333 - RNA, 20 nt, Artificial Sequence
  targeting sequence with TTCN PAM
gaaaauuuuaaaauuacauu

SEQ ID NO: 22334 - RNA, 20 nt, Artificial Sequence
  targeting sequence with TTCN PAM
gaaaaccagauugaaucuug

SEQ ID NO: 22335 - RNA, 20 nt, Artificial Sequence
  targeting sequence with TTCN PAM
cacguacaaauaaauuguau

SEQ ID NO: 22336 - RNA, 20 nt, Artificial Sequence
  targeting sequence with TTCN PAM
ggauaagugacauguuuaua

SEQ ID NO: 22337 - RNA, 20 nt, Artificial Sequence
  targeting sequence with TTCN PAM
cuuuaucaccauauaaacau

SEQ ID NO: 22338 - RNA, 20 nt, Artificial Sequence
  targeting sequence with TTCN PAM
uaucaaaaucaccaagcaug

SEQ ID NO: 22339 - RNA, 20 nt, Artificial Sequence
  targeting sequence with TTCN PAM
caugcuuggugauuuugaua

SEQ ID NO: 22340 - RNA, 20 nt, Artificial Sequence
  targeting sequence with TTCN PAM
ucacucagcacagccucuuu

SEQ ID NO: 22341 - RNA, 20 nt, Artificial Sequence
  targeting sequence with TTCN PAM
guccacuucagggccaaguc

SEQ ID NO: 22342 - RNA, 20 nt, Artificial Sequence
  targeting sequence with TTCN PAM
gggccaagucuuugccaugg

SEQ ID NO: 22343 - RNA, 20 nt, Artificial Sequence
  targeting sequence with TTCN PAM
ggaaagcaaaaagccuuuga

SEQ ID NO: 22344 - RNA, 20 nt, Artificial Sequence
  targeting sequence with TTCN PAM
ugaagcuaaguuacacauua

SEQ ID NO: 22345 - RNA, 20 nt, Artificial Sequence
  targeting sequence with TTCN PAM
aaggcuuuuugcuuuccuga

SEQ ID NO: 22346 - RNA, 20 nt, Artificial Sequence
  targeting sequence with TTCN PAM
aguuugcugagccuugaagg

SEQ ID NO: 22347 - RNA, 20 nt, Artificial Sequence
  targeting sequence with TTCN PAM
aggcucagcaaacuggaaau

SEQ ID NO: 22348 - RNA, 20 nt, Artificial Sequence
  targeting sequence with TTCN PAM
uucaaggcucagcaaacugg

SEQ ID NO: 22349 - RNA, 20 nt, Artificial Sequence
  targeting sequence with TTCN PAM
augaagucacagcucccuga

SEQ ID NO: 22350 - RNA, 20 nt, Artificial Sequence
  targeting sequence with TTCN PAM
uugaagcugggucuaaaagc

SEQ ID NO: 22351 - RNA, 20 nt, Artificial Sequence
  targeting sequence with TTCN PAM
gugagugcucaggggaccag

SEQ ID NO: 22352 - RNA, 20 nt, Artificial Sequence
  targeting sequence with TTCN PAM
aagggacuucagugagugcu

SEQ ID NO: 22353 - RNA, 20 nt, Artificial Sequence
  targeting sequence with TTCN PAM
agucuccuaagaugccuguu

SEQ ID NO: 22354 - RNA, 20 nt, Artificial Sequence
  targeting sequence with TTCN PAM
uccagcugccacccucauuu

SEQ ID NO: 22355 - RNA, 20 nt, Artificial Sequence
  targeting sequence with TTCN PAM
ccagccagguaggcaggguu

SEQ ID NO: 22356 - RNA, 20 nt, Artificial Sequence
  targeting sequence with TTCN PAM
agcuucgugcuggcauagag

SEQ ID NO: 22357 - RNA, 20 nt, Artificial Sequence
  targeting sequence with TTCN PAM
ugcuggcauagagaauccgc

SEQ ID NO: 22358 - RNA, 20 nt, Artificial Sequence
  targeting sequence with TTCN PAM
cuaugccagcacgaagcugg

SEQ ID NO: 22359 - RNA, 20 nt, Artificial Sequence
  targeting sequence with TTCN PAM
ggcagcugcuauggcgcgga

SEQ ID NO: 22360 - RNA, 20 nt, Artificial Sequence
  targeting sequence with TTCN PAM
uucuggcagcugcuauggcg

SEQ ID NO: 22361 - RNA, 20 nt, Artificial Sequence
  targeting sequence with TTCN PAM
aagccccuucccuuugucag

SEQ ID NO: 22362 - RNA, 20 nt, Artificial Sequence
  targeting sequence with TTCN PAM
cuuugucagcuccagggaga

SEQ ID NO: 22363 - RNA, 20 nt, Artificial Sequence
  targeting sequence with TTCN PAM
cccuggagcugacaaaggga

SEQ ID NO: 22364 - RNA, 20 nt, Artificial Sequence
  targeting sequence with TTCN PAM
auugggucccagcaucaggg

SEQ ID NO: 22365 - RNA, 20 nt, Artificial Sequence
  targeting sequence with TTCN PAM
uccccuucuuaaaauguauc

SEQ ID NO: 22366 - RNA, 20 nt, Artificial Sequence
  targeting sequence with TTCN PAM
uaaaauguaucauauauuag

SEQ ID NO: 22367 - RNA, 20 nt, Artificial Sequence
  targeting sequence with TTCN PAM
gaguauuaggucggccuaau

SEQ ID NO: 22368 - RNA, 20 nt, Artificial Sequence
  targeting sequence with TTCN PAM
ggguaaaugugcuuucagag

SEQ ID NO: 22369 - RNA, 20 nt, Artificial Sequence
  targeting sequence with TTCN PAM
cucauuugcuuucaggguaa

SEQ ID NO: 22370 - RNA, 20 nt, Artificial Sequence
  targeting sequence with TTCN PAM
aguggauuuuuagcauacau

SEQ ID NO: 22371 - RNA, 20 nt, Artificial Sequence
  targeting sequence with TTCN PAM
gacacaugaguguuaaucau

SEQ ID NO: 22372 - RNA, 20 nt, Artificial Sequence
  targeting sequence with TTCN PAM
ccaugauuaacacucaugug

SEQ ID NO: 22373 - RNA, 20 nt, Artificial Sequence
  targeting sequence with TTCN PAM
cagugaggcugacacaaagu

SEQ ID NO: 22374 - RNA, 20 nt, Artificial Sequence
  targeting sequence with TTCN PAM
ugagacaaaccacuucuuac

SEQ ID NO: 22375 - RNA, 20 nt, Artificial Sequence
  targeting sequence with TTCN PAM
uaccaguaacauagaccugg

SEQ ID NO: 22376 - RNA, 20 nt, Artificial Sequence
  targeting sequence with TTCN PAM
cuuuuugaaaagcuccaccu

SEQ ID NO: 22377 - RNA, 20 nt, Artificial Sequence
  targeting sequence with TTCN PAM
aaaagggaaacugggagcac

SEQ ID NO: 22378 - RNA, 20 nt, Artificial Sequence
  targeting sequence with TTCN PAM
ggcaaacucccacgugugua

SEQ ID NO: 22379 - RNA, 20 nt, Artificial Sequence
  targeting sequence with TTCN PAM
gaguaguuacccaaaauaca

SEQ ID NO: 22380 - RNA, 20 nt, Artificial Sequence
  targeting sequence with TTCN PAM
gaggcuguuucucacacauu

SEQ ID NO: 22381 - RNA, 20 nt, Artificial Sequence
  targeting sequence with TTCN PAM
cacacauuguagggccagcc

SEQ ID NO: 22382 - RNA, 20 nt, Artificial Sequence
  targeting sequence with TTCN PAM
cugggcuggcccuacaaugu

SEQ ID NO: 22383 - RNA, 20 nt, Artificial Sequence
  targeting sequence with TTCN PAM
gagguaugcugaggccgaag

SEQ ID NO: 22384 - RNA, 20 nt, Artificial Sequence
  targeting sequence with TTCN PAM
gccucagcauaccucugaag

SEQ ID NO: 22385 - RNA, 20 nt, Artificial Sequence
  targeting sequence with TTCN PAM
uucggccucagcauaccucu

SEQ ID NO: 22386 - RNA, 20 nt, Artificial Sequence
  targeting sequence with TTCN PAM
uucucagguccucuccugag

SEQ ID NO: 22387 - RNA, 20 nt, Artificial Sequence
  targeting sequence with TTCN PAM
cagguccucuccugagcacc

SEQ ID NO: 22388 - RNA, 20 nt, Artificial Sequence
  targeting sequence with TTCN PAM
cugccucagauucccccaug

SEQ ID NO: 22389 - RNA, 20 nt, Artificial Sequence
  targeting sequence with TTCN PAM
cccauggccuccugcugucc

SEQ ID NO: 22390 - RNA, 20 nt, Artificial Sequence
  targeting sequence with TTCN PAM
caccccugcagaccugaccu

SEQ ID NO: 22391 - RNA, 20 nt, Artificial Sequence
  targeting sequence with TTCN PAM
gcugagaagcaacuaaccag

SEQ ID NO: 22392 - RNA, 20 nt, Artificial Sequence
  targeting sequence with TTCN PAM
cagcugaaugguuagggauc

SEQ ID NO: 22393 - RNA, 20 nt, Artificial Sequence
  targeting sequence with TTCN PAM
aggaaaguaacuggggcaaa

SEQ ID NO: 22394 - RNA, 20 nt, Artificial Sequence
  targeting sequence with TTCN PAM
uggaacagauaacaagcaaa

SEQ ID NO: 22395 - RNA, 20 nt, Artificial Sequence
  targeting sequence with TTCN PAM
cuaguucagggcacagaaug

SEQ ID NO: 22396 - RNA, 20 nt, Artificial Sequence
  targeting sequence with TTCN PAM
gggcacagaauguuugcugg

SEQ ID NO: 22397 - RNA, 20 nt, Artificial Sequence
  targeting sequence with TTCN PAM
gugcccugaacuagagaauc

SEQ ID NO: 22398 - RNA, 20 nt, Artificial Sequence
  targeting sequence with TTCN PAM
ccuaaacuuacacaaacaaa

SEQ ID NO: 22399 - RNA, 20 nt, Artificial Sequence
  targeting sequence with TTCN PAM
gagugaggcugagcaugggu

SEQ ID NO: 22400 - RNA, 20 nt, Artificial Sequence
  targeting sequence with TTCN PAM
gaucauaugggugauaccac

SEQ ID NO: 22401 - RNA, 20 nt, Artificial Sequence
  targeting sequence with TTCN PAM
acauaucgagaccugucauc

SEQ ID NO: 22402 - RNA, 20 nt, Artificial Sequence
  targeting sequence with TTCN PAM
uaaacagcaaugagacaacc

SEQ ID NO: 22403 - RNA, 20 nt, Artificial Sequence
  targeting sequence with TTCN PAM
ugaucaggcugucucucucu

SEQ ID NO: 22404 - RNA, 20 nt, Artificial Sequence
  targeting sequence with TTCN PAM
ugugcagugccccaaauagu

SEQ ID NO: 22405 - RNA, 20 nt, Artificial Sequence
  targeting sequence with TTCN PAM
agacuauuuggggcacugca

SEQ ID NO: 22406 - RNA, 20 nt, Artificial Sequence
  targeting sequence with TTCN PAM
ucggcuaaacaacacuuucu

SEQ ID NO: 22407 - RNA, 20 nt, Artificial Sequence
  targeting sequence with TTCN PAM
cgucucacaaaugggcauuu

SEQ ID NO: 22408 - RNA, 20 nt, Artificial Sequence
  targeting sequence with TTCN PAM
uucccgucucacaaaugggc

SEQ ID NO: 22409 - RNA, 20 nt, Artificial Sequence
  targeting sequence with TTCN PAM
ugggggauccugggacagca

SEQ ID NO: 22410 - RNA, 20 nt, Artificial Sequence
  targeting sequence with TTCN PAM
cgagaccugggacuccccca

SEQ ID NO: 22411 - RNA, 20 nt, Artificial Sequence
  targeting sequence with TTCN PAM
gccauguggagcccgcccuu

SEQ ID NO: 22412 - RNA, 20 nt, Artificial Sequence
  targeting sequence with TTCN PAM
agcagcaagggcgggcucca

SEQ ID NO: 22413 - RNA, 20 nt, Artificial Sequence
  targeting sequence with TTCN PAM
ugugccagcguuacaucagg

SEQ ID NO: 22414 - RNA, 20 nt, Artificial Sequence
  targeting sequence with TTCN PAM
gauccagaguguuuuuguuu

SEQ ID NO: 22415 - RNA, 20 nt, Artificial Sequence
  targeting sequence with TTCN PAM
ucaggauuuccuuggaucug

SEQ ID NO: 22416 - RNA, 20 nt, Artificial Sequence
  targeting sequence with TTCN PAM
uuggaucuggagaccccaaa

SEQ ID NO: 22417 - RNA, 20 nt, Artificial Sequence
  targeting sequence with TTCN PAM
uuggggucuccagauccaag

SEQ ID NO: 22418 - RNA, 20 nt, Artificial Sequence
  targeting sequence with TTCN PAM
ggcccagucagccuguuugg

SEQ ID NO: 22419 - RNA, 20 nt, Artificial Sequence
  targeting sequence with TTCN PAM
cggggcagggaccaaaaccu

SEQ ID NO: 22420 - RNA, 20 nt, Artificial Sequence
  targeting sequence with TTCN PAM
cuugucagucaagaggugac

SEQ ID NO: 22421 - RNA, 20 nt, Artificial Sequence
  targeting sequence with TTCN PAM
aauuaucuaaagcuaaugug

SEQ ID NO: 22422 - RNA, 20 nt, Artificial Sequence
  targeting sequence with TTCN PAM
ucaggagacacagagauugc

SEQ ID NO: 22423 - RNA, 20 nt, Artificial Sequence
  targeting sequence with TTCN PAM
ggagacacagagauugcaca

SEQ ID NO: 22424 - RNA, 20 nt, Artificial Sequence
  targeting sequence with TTCN PAM
aggagcuuguggagucacua

SEQ ID NO: 22425 - RNA, 20 nt, Artificial Sequence
  targeting sequence with TTCN PAM
ccuagugacuccacaagcuc

SEQ ID NO: 22426 - RNA, 20 nt, Artificial Sequence
  targeting sequence with TTCN PAM
cugguccccaccaucccuuc

SEQ ID NO: 22427 - RNA, 20 nt, Artificial Sequence
  targeting sequence with TTCN PAM
aggcauuagguuuuccaccu

SEQ ID NO: 22428 - RNA, 20 nt, Artificial Sequence
  targeting sequence with TTCN PAM
accuaugccaucagggcugg

SEQ ID NO: 22429 - RNA, 20 nt, Artificial Sequence
  targeting sequence with TTCN PAM
ucaucugcaaggugggcgag

SEQ ID NO: 22430 - RNA, 20 nt, Artificial Sequence
  targeting sequence with TTCN PAM
guuucaucaucugcaaggug

SEQ ID NO: 22431 - RNA, 20 nt, Artificial Sequence
  targeting sequence with TTCN PAM
caaaguccagauagcuggaa

SEQ ID NO: 22432 - RNA, 20 nt, Artificial Sequence
  targeting sequence with TTCN PAM
agcuaucuggacuuugggaa

SEQ ID NO: 22433 - RNA, 20 nt, Artificial Sequence
  targeting sequence with TTCN PAM
uaccauuacacgcguaguug

SEQ ID NO: 22434 - RNA, 20 nt, Artificial Sequence
  targeting sequence with TTCN PAM
aaauccaucagggaagaauu

SEQ ID NO: 22435 - RNA, 20 nt, Artificial Sequence
  targeting sequence with TTCN PAM
cugauggauuuggaacuugu

SEQ ID NO: 22436 - RNA, 20 nt, Artificial Sequence
  targeting sequence with TTCN PAM
ucccugauggauuuggaacu

SEQ ID NO: 22437 - RNA, 20 nt, Artificial Sequence
  targeting sequence with TTCN PAM
uaugggaggaaccauggaua

SEQ ID NO: 22438 - RNA, 20 nt, Artificial Sequence
  targeting sequence with TTCN PAM
ucccauaagaauucuucccu

SEQ ID NO: 22439 - RNA, 20 nt, Artificial Sequence
  targeting sequence with TTCN PAM
cuuaggagacacucuuucca

SEQ ID NO: 22440 - RNA, 20 nt, Artificial Sequence
  targeting sequence with TTCN PAM
augaagggaccuuaaagaau

SEQ ID NO: 22441 - RNA, 20 nt, Artificial Sequence
  targeting sequence with TTCN PAM
uggaaagagugucuccuaag

SEQ ID NO: 22442 - RNA, 20 nt, Artificial Sequence
  targeting sequence with TTCN PAM
uuaaggucccuucauggaaa

SEQ ID NO: 22443 - RNA, 20 nt, Artificial Sequence
  targeting sequence with TTCN PAM
aagagguaaauagagauggc

SEQ ID NO: 22444 - RNA, 20 nt, Artificial Sequence
  targeting sequence with TTCN PAM
cgccaucucuauuuaccucu

SEQ ID NO: 22445 - RNA, 20 nt, Artificial Sequence
  targeting sequence with TTCN PAM
ugccugcauauccuuucccg

SEQ ID NO: 22446 - RNA, 20 nt, Artificial Sequence
  targeting sequence with TTCN PAM
gcuguacuuccugccugcau

SEQ ID NO: 22447 - RNA, 20 nt, Artificial Sequence
  targeting sequence with TTCN PAM
aaccagagccaacucgcugu

SEQ ID NO: 22448 - RNA, 20 nt, Artificial Sequence
  targeting sequence with TTCN PAM
cacacgucuuuuauuccaac

SEQ ID NO: 22449 - RNA, 20 nt, Artificial Sequence
  targeting sequence with TTCN PAM
cccucccauucccacacguc

SEQ ID NO: 22450 - RNA, 20 nt, Artificial Sequence
  targeting sequence with TTCN PAM
cccaacccacagcccauguc

SEQ ID NO: 22451 - RNA, 20 nt, Artificial Sequence
  targeting sequence with TTCN PAM
aguguggccagcccacuucc

SEQ ID NO: 22452 - RNA, 20 nt, Artificial Sequence
  targeting sequence with TTCN PAM
accugccugccugagggggu

SEQ ID NO: 22453 - RNA, 20 nt, Artificial Sequence
  targeting sequence with TTCN PAM
cuccugcucuacugcacuag

SEQ ID NO: 22454 - RNA, 20 nt, Artificial Sequence
  targeting sequence with TTCN PAM
cucucaugcccucagcuacc

SEQ ID NO: 22455 - RNA, 20 nt, Artificial Sequence
  targeting sequence with TTCN PAM
aacacugcuacuucucucuc

SEQ ID NO: 22456 - RNA, 20 nt, Artificial Sequence
  targeting sequence with TTCN PAM
ucaagguggacaacagggag

SEQ ID NO: 22457 - RNA, 20 nt, Artificial Sequence
  targeting sequence with TTCN PAM
gccuugggacucagcacacc

SEQ ID NO: 22458 - RNA, 20 nt, Artificial Sequence
  targeting sequence with TTCN PAM
cccucaagguccggugugcu

SEQ ID NO: 22459 - RNA, 20 nt, Artificial Sequence
  targeting sequence with TTCN PAM
ggcucaagcaugugcacaca

SEQ ID NO: 22460 - RNA, 20 nt, Artificial Sequence
  targeting sequence with TTCN PAM
ucuggaaacaacguuguggu

SEQ ID NO: 22461 - RNA, 20 nt, Artificial Sequence
  targeting sequence with TTCN PAM
ggaaacaacguuguggucua

SEQ ID NO: 22462 - RNA, 20 nt, Artificial Sequence
  targeting sequence with TTCN PAM
agaagaaucaacagccuuua

SEQ ID NO: 22463 - RNA, 20 nt, Artificial Sequence
  targeting sequence with TTCN PAM
auauccccaaauccuggcug

SEQ ID NO: 22464 - RNA, 20 nt, Artificial Sequence
  targeting sequence with TTCN PAM
uugggugcugccauauauua

SEQ ID NO: 22465 - RNA, 20 nt, Artificial Sequence
  targeting sequence with TTCN PAM
uguccgauaguaauuuuuuu

SEQ ID NO: 22466 - RNA, 20 nt, Artificial Sequence
  targeting sequence with TTCN PAM
ccacauuauucuuuaaauga

SEQ ID NO: 22467 - RNA, 20 nt, Artificial Sequence
  targeting sequence with TTCN PAM
uuaaaugaagggguucauau

SEQ ID NO: 22468 - RNA, 20 nt, Artificial Sequence
  targeting sequence with TTCN PAM
uuuaaagaauaaugugggga

SEQ ID NO: 22469 - RNA, 20 nt, Artificial Sequence
  targeting sequence with TTCN PAM
uauagaagagagccaggcag

SEQ ID NO: 22470 - RNA, 20 nt, Artificial Sequence
  targeting sequence with TTCN PAM
auaugaaccccuucauuuaa

SEQ ID NO: 22471 - RNA, 20 nt, Artificial Sequence
  targeting sequence with TTCN PAM
cucuucugguuuuucuuguc

SEQ ID NO: 22472 - RNA, 20 nt, Artificial Sequence
  targeting sequence with TTCN PAM
gguuuuucuugucacuuuca

SEQ ID NO: 22473 - RNA, 20 nt, Artificial Sequence
  targeting sequence with TTCN PAM
ugucacuuucauuuguaagu

SEQ ID NO: 22474 - RNA, 20 nt, Artificial Sequence
  targeting sequence with TTCN PAM
uuuguaagugcuauaguauc

SEQ ID NO: 22475 - RNA, 20 nt, Artificial Sequence
  targeting sequence with TTCN PAM
agaaacacauuaagcauguu

SEQ ID NO: 22476 - RNA, 20 nt, Artificial Sequence
  targeting sequence with TTCN PAM
ugaauuacucaaguacccuc

SEQ ID NO: 22477 - RNA, 20 nt, Artificial Sequence
  targeting sequence with TTCN PAM
gcuugcuuuccagauguggc

SEQ ID NO: 22478 - RNA, 20 nt, Artificial Sequence
  targeting sequence with TTCN PAM
agauguggcuauaaaaggug

SEQ ID NO: 22479 - RNA, 20 nt, Artificial Sequence
  targeting sequence with TTCN PAM
uccagggacguuggguguga

SEQ ID NO: 22480 - RNA, 20 nt, Artificial Sequence
  targeting sequence with TTCN PAM
cacccaucacacccaacguc

SEQ ID NO: 22481 - RNA, 20 nt, Artificial Sequence
  targeting sequence with TTCN PAM
aaggcuguaagggcugucua

SEQ ID NO: 22482 - RNA, 20 nt, Artificial Sequence
  targeting sequence with TTCN PAM
cuaaaaacguguccuuuuuc

SEQ ID NO: 22483 - RNA, 20 nt, Artificial Sequence
  targeting sequence with TTCN PAM
gcugagcaguguuauuuuua

SEQ ID NO: 22484 - RNA, 20 nt, Artificial Sequence
  targeting sequence with TTCN PAM
aaguguagacugacaggccu

SEQ ID NO: 22485 - RNA, 20 nt, Artificial Sequence
  targeting sequence with TTCN PAM
uuacagcugcuucuccuucc

SEQ ID NO: 22486 - RNA, 20 nt, Artificial Sequence
  targeting sequence with TTCN PAM
ccuuccuuucucaccaagac

SEQ ID NO: 22487 - RNA, 20 nt, Artificial Sequence
  targeting sequence with TTCN PAM
uuucucaccaagacuagccu

SEQ ID NO: 22488 - RNA, 20 nt, Artificial Sequence
  targeting sequence with TTCN PAM
caccaagacuagccugggua

SEQ ID NO: 22489 - RNA, 20 nt, Artificial Sequence
  targeting sequence with TTCN PAM
acccaggcuagucuugguga

SEQ ID NO: 22490 - RNA, 20 nt, Artificial Sequence
  targeting sequence with TTCN PAM
ccugggagaguuaguuugac

SEQ ID NO: 22491 - RNA, 20 nt, Artificial Sequence
  targeting sequence with TTCN PAM
agccugaccagagagaacaa

SEQ ID NO: 22492 - RNA, 20 nt, Artificial Sequence
  targeting sequence with TTCN PAM
cucuggucaggcuggaauuu

SEQ ID NO: 22493 - RNA, 20 nt, Artificial Sequence
  targeting sequence with TTCN PAM
auccaggccucaugucccca

SEQ ID NO: 22494 - RNA, 20 nt, Artificial Sequence
  targeting sequence with TTCN PAM
ccauggugagcagcccuccc

SEQ ID NO: 22495 - RNA, 20 nt, Artificial Sequence
  targeting sequence with TTCN PAM
cuguccuccuggccaacgug

SEQ ID NO: 22496 - RNA, 20 nt, Artificial Sequence
  targeting sequence with TTCN PAM
ugcaggccuuuguccagagc

SEQ ID NO: 22497 - RNA, 20 nt, Artificial Sequence
  targeting sequence with TTCN PAM
uuuagagggcagucauugag

SEQ ID NO: 22498 - RNA, 20 nt, Artificial Sequence
  targeting sequence with TTCN PAM
uaugccuuggcauccacuuu

SEQ ID NO: 22499 - RNA, 20 nt, Artificial Sequence
  targeting sequence with TTCN PAM
gugagaauuccugcacccgu

SEQ ID NO: 22500 - RNA, 20 nt, Artificial Sequence
  targeting sequence with TTCN PAM
cacggaaaaguggaugccaa

SEQ ID NO: 22501 - RNA, 20 nt, Artificial Sequence
  targeting sequence with TTCN PAM
ugcacccgugguggaaagag

SEQ ID NO: 22502 - RNA, 20 nt, Artificial Sequence
  targeting sequence with TTCN PAM
accacgggugcaggaauucu

SEQ ID NO: 22503 - RNA, 20 nt, Artificial Sequence
  targeting sequence with TTCN PAM
ccuuccccacagacuuuauu

SEQ ID NO: 22504 - RNA, 20 nt, Artificial Sequence
  targeting sequence with TTCN PAM
ccacagacuuuauucuucuc

SEQ ID NO: 22505 - RNA, 20 nt, Artificial Sequence
  targeting sequence with TTCN PAM
ucucaucugagagauggaaa

SEQ ID NO: 22506 - RNA, 20 nt, Artificial Sequence
  targeting sequence with TTCN PAM
caucugagagauggaaauaa

SEQ ID NO: 22507 - RNA, 20 nt, Artificial Sequence
  targeting sequence with TTCN PAM
aucucucagaugagaagaau

SEQ ID NO: 22508 - RNA, 20 nt, Artificial Sequence
  targeting sequence with TTCN PAM
ccacccuaagaggugggcau

SEQ ID NO: 22509 - RNA, 20 nt, Artificial Sequence
  targeting sequence with TTCN PAM
gauuucacgcaugggaaagc

SEQ ID NO: 22510 - RNA, 20 nt, Artificial Sequence
  targeting sequence with TTCN PAM
cgcaugggaaagcucauggc

SEQ ID NO: 22511 - RNA, 20 nt, Artificial Sequence
  targeting sequence with TTCN PAM
caugcgugaaaucagaaucu

SEQ ID NO: 22512 - RNA, 20 nt, Artificial Sequence
  targeting sequence with TTCN PAM
cucuccagguugaucgacau

SEQ ID NO: 22513 - RNA, 20 nt, Artificial Sequence
  targeting sequence with TTCN PAM
ugagguagguagcgcacagc

SEQ ID NO: 22514 - RNA, 20 nt, Artificial Sequence
  targeting sequence with TTCN PAM
gguaggucucagcagcauag

SEQ ID NO: 22515 - RNA, 20 nt, Artificial Sequence
  targeting sequence with TTCN PAM
ccucaccucaucccagcgcu

SEQ ID NO: 22516 - RNA, 20 nt, Artificial Sequence
  targeting sequence with TTCN PAM
gauggagagaagcugcccuc

SEQ ID NO: 22517 - RNA, 20 nt, Artificial Sequence
  targeting sequence with TTCN PAM
cuccaucugaaccccaaagg

SEQ ID NO: 22518 - RNA, 20 nt, Artificial Sequence
  targeting sequence with TTCN PAM
aucacgagggcagcuucucu

SEQ ID NO: 22519 - RNA, 20 nt, Artificial Sequence
  targeting sequence with TTCN PAM
uuccaucacgagggcagcuu

SEQ ID NO: 22520 - RNA, 20 nt, Artificial Sequence
  targeting sequence with TTCN PAM
agguuaaguuaccugacugc

SEQ ID NO: 22521 - RNA, 20 nt, Artificial Sequence
  targeting sequence with TTCN PAM
cugagccacagaaucgugga

SEQ ID NO: 22522 - RNA, 20 nt, Artificial Sequence
  targeting sequence with TTCN PAM
guggcucagagaauucgagg

SEQ ID NO: 22523 - RNA, 20 nt, Artificial Sequence
  targeting sequence with TTCN PAM
acuugucccuucauucaguc

SEQ ID NO: 22524 - RNA, 20 nt, Artificial Sequence
  targeting sequence with TTCN PAM
uucagucauugagaaaaucg

SEQ ID NO: 22525 - RNA, 20 nt, Artificial Sequence
  targeting sequence with TTCN PAM
gucauugagaaaaucguuac

SEQ ID NO: 22526 - RNA, 20 nt, Artificial Sequence
  targeting sequence with TTCN PAM
caaugacugaaugaagggac

SEQ ID NO: 22527 - RNA, 20 nt, Artificial Sequence
  targeting sequence with TTCN PAM
cacuaacauccccggugccu

SEQ ID NO: 22528 - RNA, 20 nt, Artificial Sequence
  targeting sequence with TTCN PAM
gccaaaaugcuacccagcag

SEQ ID NO: 22529 - RNA, 20 nt, Artificial Sequence
  targeting sequence with TTCN PAM
agauccagacugugagagcc

SEQ ID NO: 22530 - RNA, 20 nt, Artificial Sequence
  targeting sequence with TTCN PAM
ggggccaguuuuuucccucc

SEQ ID NO: 22531 - RNA, 20 nt, Artificial Sequence
  targeting sequence with TTCN PAM
cucccuucucugcccccacc

SEQ ID NO: 22532 - RNA, 20 nt, Artificial Sequence
  targeting sequence with TTCN PAM
cugcccccaccccacaacca

SEQ ID NO: 22533 - RNA, 20 nt, Artificial Sequence
  targeting sequence with TTCN PAM
cucuggugucaggggcugua

SEQ ID NO: 22534 - RNA, 20 nt, Artificial Sequence
  targeting sequence with TTCN PAM
uuacagccccugacaccaga

SEQ ID NO: 22535 - RNA, 20 nt, Artificial Sequence
  targeting sequence with TTCN PAM
cgcugaccuggcuaauucuu

SEQ ID NO: 22536 - RNA, 20 nt, Artificial Sequence
  targeting sequence with TTCN PAM
gccagccugaggcuggccac

SEQ ID NO: 22537 - RNA, 20 nt, Artificial Sequence
  targeting sequence with TTCN PAM
auggcucaacccccacccuc

SEQ ID NO: 22538 - RNA, 20 nt, Artificial Sequence
  targeting sequence with TTCN PAM
cugcagagaaauccaucccc

SEQ ID NO: 22539 - RNA, 20 nt, Artificial Sequence
  targeting sequence with TTCN PAM
cugcagggaacagggagcca

SEQ ID NO: 22540 - RNA, 20 nt, Artificial Sequence
  targeting sequence with TTCN PAM
cucuaaaauggaccaugaug

SEQ ID NO: 22541 - RNA, 20 nt, Artificial Sequence
  targeting sequence with TTCN PAM
cugagaggagccgucugacu

SEQ ID NO: 22542 - RNA, 20 nt, Artificial Sequence
  targeting sequence with TTCN PAM
gagagcagacaacagucaga

SEQ ID NO: 22543 - RNA, 20 nt, Artificial Sequence
  targeting sequence with TTCN PAM
caugacugaccucaucaccu

SEQ ID NO: 22544 - RNA, 20 nt, Artificial Sequence
  targeting sequence with TTCN PAM
caagagaaauuuauuagauu

SEQ ID NO: 22545 - RNA, 20 nt, Artificial Sequence
  targeting sequence with TTCN PAM
cuugagaagccaccauugcc

SEQ ID NO: 22546 - RNA, 20 nt, Artificial Sequence
  targeting sequence with TTCN PAM
caagcagcauagauuagagc

SEQ ID NO: 22547 - RNA, 20 nt, Artificial Sequence
  targeting sequence with TTCN PAM
aagaugcucuaaucuaugcu

SEQ ID NO: 22548 - RNA, 20 nt, Artificial Sequence
  targeting sequence with TTCN PAM
caccauggcucauguccggu

SEQ ID NO: 22549 - RNA, 20 nt, Artificial Sequence
  targeting sequence with TTCN PAM
ccuggccugacaggugguuc

SEQ ID NO: 22550 - RNA, 20 nt, Artificial Sequence
  targeting sequence with TTCN PAM
ggggcuuaggugagaagcag

SEQ ID NO: 22551 - RNA, 20 nt, Artificial Sequence
  targeting sequence with TTCN PAM
caccuaagccccagaaccac

SEQ ID NO: 22552 - RNA, 20 nt, Artificial Sequence
  targeting sequence with TTCN PAM
ugcuguauggacccacugac

SEQ ID NO: 22553 - RNA, 20 nt, Artificial Sequence
  targeting sequence with TTCN PAM
uaucaguugucaaagaugac

SEQ ID NO: 22554 - RNA, 20 nt, Artificial Sequence
  targeting sequence with TTCN PAM
guuuccuuaggugucgcccg

SEQ ID NO: 22555 - RNA, 20 nt, Artificial Sequence
  targeting sequence with TTCN PAM
uuaggugucgcccgcaauua

SEQ ID NO: 22556 - RNA, 20 nt, Artificial Sequence
  targeting sequence with TTCN PAM
uuuaauugcgggcgacaccu

SEQ ID NO: 22557 - RNA, 20 nt, Artificial Sequence
  targeting sequence with TTCN PAM
gauucugugccgcuucugug

SEQ ID NO: 22558 - RNA, 20 nt, Artificial Sequence
  targeting sequence with TTCN PAM
gugccgcuucugugguccag

SEQ ID NO: 22559 - RNA, 20 nt, Artificial Sequence
  targeting sequence with TTCN PAM
gugguccagaaacagacugu

SEQ ID NO: 22560 - RNA, 20 nt, Artificial Sequence
  targeting sequence with TTCN PAM
ggaccacagaagcggcacag

SEQ ID NO: 22561 - RNA, 20 nt, Artificial Sequence
  targeting sequence with TTCN PAM
guaacaacacagucuguuuc

SEQ ID NO: 22562 - RNA, 20 nt, Artificial Sequence
  targeting sequence with TTCN PAM
aagagcugauuuguuuuugc

SEQ ID NO: 22563 - RNA, 20 nt, Artificial Sequence
  targeting sequence with TTCN PAM
aaaacaaaaggcaauuaaca

SEQ ID NO: 22564 - RNA, 20 nt, Artificial Sequence
  targeting sequence with TTCN PAM
guggguaguuuuuuggggga

SEQ ID NO: 22565 - RNA, 20 nt, Artificial Sequence
  targeting sequence with TTCN PAM
gccaaguacaguguuuucau

SEQ ID NO: 22566 - RNA, 20 nt, Artificial Sequence
  targeting sequence with TTCN PAM
ugggggcugcaggggcagcu

SEQ ID NO: 22567 - RNA, 20 nt, Artificial Sequence
  targeting sequence with TTCN PAM
uuugcuccuucccccaggcc

SEQ ID NO: 22568 - RNA, 20 nt, Artificial Sequence
  targeting sequence with TTCN PAM
cccaggccuuugcuuugggu

SEQ ID NO: 22569 - RNA, 20 nt, Artificial Sequence
  targeting sequence with TTCN PAM
cacccaaagcaaaggccugg

SEQ ID NO: 22570 - RNA, 20 nt, Artificial Sequence
  targeting sequence with TTCN PAM
cugcuagccacugagcauac

SEQ ID NO: 22571 - RNA, 20 nt, Artificial Sequence
  targeting sequence with TTCN PAM
ucaaagcgaucguucucugc

SEQ ID NO: 22572 - RNA, 20 nt, Artificial Sequence
  targeting sequence with TTCN PAM
gggcuuccucaaagcgaucg

SEQ ID NO: 22573 - RNA, 20 nt, Artificial Sequence
  targeting sequence with TTCN PAM
agaaggagcaggagaaguua

SEQ ID NO: 22574 - RNA, 20 nt, Artificial Sequence
  targeting sequence with TTCN PAM
agaaggugacagucuguguu

SEQ ID NO: 22575 - RNA, 20 nt, Artificial Sequence
  targeting sequence with TTCN PAM
augcuccacagucuuucacc

SEQ ID NO: 22576 - RNA, 20 nt, Artificial Sequence
  targeting sequence with TTCN PAM
cguuuaauccucgcaacagc

SEQ ID NO: 22577 - RNA, 20 nt, Artificial Sequence
  targeting sequence with TTCN PAM
cauuuugcagaugagaaaac

SEQ ID NO: 22578 - RNA, 20 nt, Artificial Sequence
  targeting sequence with TTCN PAM
caucugcaaaaugggaauca

SEQ ID NO: 22579 - RNA, 20 nt, Artificial Sequence
  targeting sequence with TTCN PAM
guuuucucaucugcaaaaug

SEQ ID NO: 22580 - RNA, 20 nt, Artificial Sequence
  targeting sequence with TTCN PAM
ccucuuuacccuucaguuuu

SEQ ID NO: 22581 - RNA, 20 nt, Artificial Sequence
  targeting sequence with TTCN PAM
ucaccucuuuacccuucagu

SEQ ID NO: 22582 - RNA, 20 nt, Artificial Sequence
  targeting sequence with TTCN PAM
ggcaaauuucuucaccucuu

SEQ ID NO: 22583 - RNA, 20 nt, Artificial Sequence
  targeting sequence with TTCN PAM
uagcuaggaaguggcaggga

SEQ ID NO: 22584 - RNA, 20 nt, Artificial Sequence
  targeting sequence with TTCN PAM
uagcuaugaaacuucaggca

SEQ ID NO: 22585 - RNA, 20 nt, Artificial Sequence
  targeting sequence with TTCN PAM
caguagagaccaugccucac

SEQ ID NO: 22586 - RNA, 20 nt, Artificial Sequence
  targeting sequence with TTCN PAM
auucucaguagagaccaugc

SEQ ID NO: 22587 - RNA, 20 nt, Artificial Sequence
  targeting sequence with TTCN PAM
auuucuggcucagauaaacg

SEQ ID NO: 22588 - RNA, 20 nt, Artificial Sequence
  targeting sequence with TTCN PAM
ggcucagauaaacgggugac

SEQ ID NO: 22589 - RNA, 20 nt, Artificial Sequence
  targeting sequence with TTCN PAM
gcuccucaagaauucuguug

SEQ ID NO: 22590 - RNA, 20 nt, Artificial Sequence
  targeting sequence with TTCN PAM
ugaggagcagaagucacccg

SEQ ID NO: 22591 - RNA, 20 nt, Artificial Sequence
  targeting sequence with TTCN PAM
guugguaaaaugggcugcac

SEQ ID NO: 22592 - RNA, 20 nt, Artificial Sequence
  targeting sequence with TTCN PAM
gaugcuguuguacgcugugu

SEQ ID NO: 22593 - RNA, 20 nt, Artificial Sequence
  targeting sequence with TTCN PAM
auacuugcuuuaacuccuau

SEQ ID NO: 22594 - RNA, 20 nt, Artificial Sequence
  targeting sequence with TTCN PAM
cugauguuauuaaucauauu

SEQ ID NO: 22595 - RNA, 20 nt, Artificial Sequence
  targeting sequence with TTCN PAM
cucucugugucaggcccugg

SEQ ID NO: 22596 - RNA, 20 nt, Artificial Sequence
  targeting sequence with TTCN PAM
agguuacauagguuaagugc

SEQ ID NO: 22597 - RNA, 20 nt, Artificial Sequence
  targeting sequence with TTCN PAM
uccuugcacagcuguuggca

SEQ ID NO: 22598 - RNA, 20 nt, Artificial Sequence
  targeting sequence with TTCN PAM
ggcucugcugcugacuagau

SEQ ID NO: 22599 - RNA, 20 nt, Artificial Sequence
  targeting sequence with TTCN PAM
ccagucagagagguacuggu

SEQ ID NO: 22600 - RNA, 20 nt, Artificial Sequence
  targeting sequence with TTCN PAM
guuuugcugccuauuuagcc

SEQ ID NO: 22601 - RNA, 20 nt, Artificial Sequence
  targeting sequence with TTCN PAM
aauggaaguuggguguuuga

SEQ ID NO: 22602 - RNA, 20 nt, Artificial Sequence
  targeting sequence with TTCN PAM
auuagaaggcuaaauaggca

SEQ ID NO: 22603 - RNA, 20 nt, Artificial Sequence
  targeting sequence with TTCN PAM
auagcaucugauuuacgcuu

SEQ ID NO: 22604 - RNA, 20 nt, Artificial Sequence
  targeting sequence with TTCN PAM
auaugguaaccguugcccuc

SEQ ID NO: 22605 - RNA, 20 nt, Artificial Sequence
  targeting sequence with TTCN PAM
gcaauguguccagagagggc

SEQ ID NO: 22606 - RNA, 20 nt, Artificial Sequence
  targeting sequence with TTCN PAM
guugaggggcuccaacaggg

SEQ ID NO: 22607 - RNA, 20 nt, Artificial Sequence
  targeting sequence with TTCN PAM
augagggcuuucgguugagg

SEQ ID NO: 22608 - RNA, 20 nt, Artificial Sequence
  targeting sequence with TTCN PAM
cugcugcuucagcauuucca

SEQ ID NO: 22609 - RNA, 20 nt, Artificial Sequence
  targeting sequence with TTCN PAM
gcauuuccagagcacccagu

SEQ ID NO: 22610 - RNA, 20 nt, Artificial Sequence
  targeting sequence with TTCN PAM
agagcacccaguugcugaag

SEQ ID NO: 22611 - RNA, 20 nt, Artificial Sequence
  targeting sequence with TTCN PAM
gcaacugggugcucuggaaa

SEQ ID NO: 22612 - RNA, 20 nt, Artificial Sequence
  targeting sequence with TTCN PAM
aagaauccaucaccauagua

SEQ ID NO: 22613 - RNA, 20 nt, Artificial Sequence
  targeting sequence with TTCN PAM
uggaagggcagacacagaca

SEQ ID NO: 22614 - RNA, 20 nt, Artificial Sequence
  targeting sequence with TTCN PAM
caucuacaaccucuugucug

SEQ ID NO: 22615 - RNA, 20 nt, Artificial Sequence
  targeting sequence with TTCN PAM
guucucaucuacaaccucuu

SEQ ID NO: 22616 - RNA, 20 nt, Artificial Sequence
  targeting sequence with TTCN PAM
ccuucucugaaggcggagga

SEQ ID NO: 22617 - RNA, 20 nt, Artificial Sequence
  targeting sequence with TTCN PAM
cugaaggcggaggauuagga

SEQ ID NO: 22618 - RNA, 20 nt, Artificial Sequence
  targeting sequence with TTCN PAM
gagaaggagaaggucuggcc

SEQ ID NO: 22619 - RNA, 20 nt, Artificial Sequence
  targeting sequence with TTCN PAM
cuggcagccaccaacaucuc

SEQ ID NO: 22620 - RNA, 20 nt, Artificial Sequence
  targeting sequence with TTCN PAM
gaguaccuacuacguggcca

SEQ ID NO: 22621 - RNA, 20 nt, Artificial Sequence
  targeting sequence with TTCN PAM
uauacuguuuaacagauauu

SEQ ID NO: 22622 - RNA, 20 nt, Artificial Sequence
  targeting sequence with TTCN PAM
caaaugguugugauaacuga

SEQ ID NO: 22623 - RNA, 20 nt, Artificial Sequence
  targeting sequence with TTCN PAM
aaguggucauugaaaagcag

SEQ ID NO: 22624 - RNA, 20 nt, Artificial Sequence
  targeting sequence with TTCN PAM
augaccacuuugaaggaucu

SEQ ID NO: 22625 - RNA, 20 nt, Artificial Sequence
  targeting sequence with TTCN PAM
aaugacugcuuuucaaugac

SEQ ID NO: 22626 - RNA, 20 nt, Artificial Sequence
  targeting sequence with TTCN PAM
gggaccuugggugugacacu

SEQ ID NO: 22627 - RNA, 20 nt, Artificial Sequence
  targeting sequence with TTCN PAM
uugcucauaaaaagggggau

SEQ ID NO: 22628 - RNA, 20 nt, Artificial Sequence
  targeting sequence with TTCN PAM
uucuucauaagucuguggug

SEQ ID NO: 22629 - RNA, 20 nt, Artificial Sequence
  targeting sequence with TTCN PAM
ucauaagucuguggugagga

SEQ ID NO: 22630 - RNA, 20 nt, Artificial Sequence
  targeting sequence with TTCN PAM
uaagucuguggugaggaucc

SEQ ID NO: 22631 - RNA, 20 nt, Artificial Sequence
  targeting sequence with TTCN PAM
aucaccuuaggagucacaaa

SEQ ID NO: 22632 - RNA, 20 nt, Artificial Sequence
  targeting sequence with TTCN PAM
agggcaaaguuuugugacuc

SEQ ID NO: 22633 - RNA, 20 nt, Artificial Sequence
  targeting sequence with TTCN PAM
gcccccugcucauuccaggg

SEQ ID NO: 22634 - RNA, 20 nt, Artificial Sequence
  targeting sequence with TTCN PAM
gugagguucugcccccugcu

SEQ ID NO: 22635 - RNA, 20 nt, Artificial Sequence
  targeting sequence with TTCN PAM
cucuuagacuuugcccugga

SEQ ID NO: 22636 - RNA, 20 nt, Artificial Sequence
  targeting sequence with TTCN PAM
agggcaaagucuaagaguga

SEQ ID NO: 22637 - RNA, 20 nt, Artificial Sequence
  targeting sequence with TTCN PAM
uuucugcaugcuuuucaaag

SEQ ID NO: 22638 - RNA, 20 nt, Artificial Sequence
  targeting sequence with TTCN PAM
gcaugcuuuucaaagucagu

SEQ ID NO: 22639 - RNA, 20 nt, Artificial Sequence
  targeting sequence with TTCN PAM
aagucagucgccuuuuccca

SEQ ID NO: 22640 - RNA, 20 nt, Artificial Sequence
  targeting sequence with TTCN PAM
cagccaaaaaggaauuuauc

SEQ ID NO: 22641 - RNA, 20 nt, Artificial Sequence
  targeting sequence with TTCN PAM
uuuuuggcugggaaaaggcg

SEQ ID NO: 22642 - RNA, 20 nt, Artificial Sequence
  targeting sequence with TTCN PAM
aggauguagccuugguuauu

SEQ ID NO: 22643 - RNA, 20 nt, Artificial Sequence
  targeting sequence with TTCN PAM
cuaaauaaccaaggcuacau

SEQ ID NO: 22644 - RNA, 20 nt, Artificial Sequence
  targeting sequence with TTCN PAM
uugcugggauggcgcuucuc

SEQ ID NO: 22645 - RNA, 20 nt, Artificial Sequence
  targeting sequence with TTCN PAM
aaagcagcccugugcaagcc

SEQ ID NO: 22646 - RNA, 20 nt, Artificial Sequence
  targeting sequence with TTCN PAM
ucccuccaccacuccuacag

SEQ ID NO: 22647 - RNA, 20 nt, Artificial Sequence
  targeting sequence with TTCN PAM
acaaggcugggcgacagaga

SEQ ID NO: 22648 - RNA, 20 nt, Artificial Sequence
  targeting sequence with TTCN PAM
cucugucgcccagccuugug

SEQ ID NO: 22649 - RNA, 20 nt, Artificial Sequence
  targeting sequence with TTCN PAM
caagccccacucugacacca

SEQ ID NO: 22650 - RNA, 20 nt, Artificial Sequence
  targeting sequence with TTCN PAM
gauguuuaucuuggugucag

SEQ ID NO: 22651 - RNA, 20 nt, Artificial Sequence
  targeting sequence with TTCN PAM
aguuugcccaucagaauggu

SEQ ID NO: 22652 - RNA, 20 nt, Artificial Sequence
  targeting sequence with TTCN PAM
gaugggcaaacuggaaaaag

SEQ ID NO: 22653 - RNA, 20 nt, Artificial Sequence
  targeting sequence with TTCN PAM
gagcauaucucuccccugcu

SEQ ID NO: 22654 - RNA, 20 nt, Artificial Sequence
  targeting sequence with TTCN PAM
cauuuaauuaaaaaaauuua

SEQ ID NO: 22655 - RNA, 20 nt, Artificial Sequence
  targeting sequence with TTCN PAM
ucuucucauuuaauuaaaaa

SEQ ID NO: 22656 - RNA, 20 nt, Artificial Sequence
  targeting sequence with TTCN PAM
uacucaucccagccaggaaa

SEQ ID NO: 22657 - RNA, 20 nt, Artificial Sequence
  targeting sequence with TTCN PAM
uggcugggaugaguaagaau

SEQ ID NO: 22658 - RNA, 20 nt, Artificial Sequence
  targeting sequence with TTCN PAM
auauugcuuucuuucacaag

SEQ ID NO: 22659 - RNA, 20 nt, Artificial Sequence
  targeting sequence with TTCN PAM
uucacaagacuucccaugau

SEQ ID NO: 22660 - RNA, 20 nt, Artificial Sequence
  targeting sequence with TTCN PAM
caagacuucccaugauguac

SEQ ID NO: 22661 - RNA, 20 nt, Artificial Sequence
  targeting sequence with TTCN PAM
caugauguacugaaggagua

SEQ ID NO: 22662 - RNA, 20 nt, Artificial Sequence
  targeting sequence with TTCN PAM
guacaucaugggaagucuug

SEQ ID NO: 22663 - RNA, 20 nt, Artificial Sequence
  targeting sequence with TTCN PAM
acuacuccuucaguacauca

SEQ ID NO: 22664 - RNA, 20 nt, Artificial Sequence
  targeting sequence with TTCN PAM
acuuccacuacuccuucagu

SEQ ID NO: 22665 - RNA, 20 nt, Artificial Sequence
  targeting sequence with TTCN PAM
ucuccacuggacaaggccac

SEQ ID NO: 22666 - RNA, 20 nt, Artificial Sequence
  targeting sequence with TTCN PAM
ccacuggacaaggccacaug

SEQ ID NO: 22667 - RNA, 20 nt, Artificial Sequence
  targeting sequence with TTCN PAM
caccccugcauguggccuug

SEQ ID NO: 22668 - RNA, 20 nt, Artificial Sequence
  targeting sequence with TTCN PAM
augccaguguuuuucccacc

SEQ ID NO: 22669 - RNA, 20 nt, Artificial Sequence
  targeting sequence with TTCN PAM
ugagcucugcaugcccaucu

SEQ ID NO: 22670 - RNA, 20 nt, Artificial Sequence
  targeting sequence with TTCN PAM
aacuguaagcaugacucugu

SEQ ID NO: 22671 - RNA, 20 nt, Artificial Sequence
  targeting sequence with TTCN PAM
guuugggccagugccuuaug

SEQ ID NO: 22672 - RNA, 20 nt, Artificial Sequence
  targeting sequence with TTCN PAM
gauaggagcagcagagggaa

SEQ ID NO: 22673 - RNA, 20 nt, Artificial Sequence
  targeting sequence with TTCN PAM
cucugcugcuccuaucagaa

SEQ ID NO: 22674 - RNA, 20 nt, Artificial Sequence
  targeting sequence with TTCN PAM
ugcucaucuuaugccucuuc

SEQ ID NO: 22675 - RNA, 20 nt, Artificial Sequence
  targeting sequence with TTCN PAM
gacacaucuugggucuugcu

SEQ ID NO: 22676 - RNA, 20 nt, Artificial Sequence
  targeting sequence with TTCN PAM
ccugggggagcgacagcugc

SEQ ID NO: 22677 - RNA, 20 nt, Artificial Sequence
  targeting sequence with TTCN PAM
agaucucucacugcacccuc

SEQ ID NO: 22678 - RNA, 20 nt, Artificial Sequence
  targeting sequence with TTCN PAM
uagguggacagggcauaagg

SEQ ID NO: 22679 - RNA, 20 nt, Artificial Sequence
  targeting sequence with TTCN PAM
ccauccuggaguggcccuac

SEQ ID NO: 22680 - RNA, 20 nt, Artificial Sequence
  targeting sequence with TTCN PAM
ccucacuacacuuugucccu

SEQ ID NO: 22681 - RNA, 20 nt, Artificial Sequence
  targeting sequence with TTCN PAM
cccaccacacagugucugug

SEQ ID NO: 22682 - RNA, 20 nt, Artificial Sequence
  targeting sequence with TTCN PAM
cagcaucaguucucccacca

SEQ ID NO: 22683 - RNA, 20 nt, Artificial Sequence
  targeting sequence with TTCN PAM
ccucccacccgcugcacaca

SEQ ID NO: 22684 - RNA, 20 nt, Artificial Sequence
  targeting sequence with TTCN PAM
gggcaggaucugcugugugc

SEQ ID NO: 22685 - RNA, 20 nt, Artificial Sequence
  targeting sequence with TTCN PAM
accacuuccagcguuuggca

SEQ ID NO: 22686 - RNA, 20 nt, Artificial Sequence
  targeting sequence with TTCN PAM
agcguuuggcagagcuguac

SEQ ID NO: 22687 - RNA, 20 nt, Artificial Sequence
  targeting sequence with TTCN PAM
auccagucugcugcucuuua

SEQ ID NO: 22688 - RNA, 20 nt, Artificial Sequence
  targeting sequence with TTCN PAM
cugugaccaguggguuacau

SEQ ID NO: 22689 - RNA, 20 nt, Artificial Sequence
  targeting sequence with TTCN PAM
ucagcaguucacugugacca

SEQ ID NO: 22690 - RNA, 20 nt, Artificial Sequence
  targeting sequence with TTCN PAM
cagaggagaccaagauuccu

SEQ ID NO: 22691 - RNA, 20 nt, Artificial Sequence
  targeting sequence with TTCN PAM
ucccagaggagaccaagauu

SEQ ID NO: 22692 - RNA, 20 nt, Artificial Sequence
  targeting sequence with TTCN PAM
uugauugacuguuugucugc

SEQ ID NO: 22693 - RNA, 20 nt, Artificial Sequence
  targeting sequence with TTCN PAM
ggagcccacugcuugaugca

SEQ ID NO: 22694 - RNA, 20 nt, Artificial Sequence
  targeting sequence with TTCN PAM
agcucuggaucacaauucag

SEQ ID NO: 22695 - RNA, 20 nt, Artificial Sequence
  targeting sequence with TTCN PAM
ucagugcaggcuuugaugac

SEQ ID NO: 22696 - RNA, 20 nt, Artificial Sequence
  targeting sequence with TTCN PAM
cugagucaucaaagccugca

SEQ ID NO: 22697 - RNA, 20 nt, Artificial Sequence
  targeting sequence with TTCN PAM
augaggcccucuccuucagu

SEQ ID NO: 22698 - RNA, 20 nt, Artificial Sequence
  targeting sequence with TTCN PAM
guagggcgaaggcccagauu

SEQ ID NO: 22699 - RNA, 20 nt, Artificial Sequence
  targeting sequence with TTCN PAM
cccuacugaaggagagggcc

SEQ ID NO: 22700 - RNA, 20 nt, Artificial Sequence
  targeting sequence with TTCN PAM
ucagcaauucacuuucccuc

SEQ ID NO: 22701 - RNA, 20 nt, Artificial Sequence
  targeting sequence with TTCN PAM
gcaauucacuuucccucucu

SEQ ID NO: 22702 - RNA, 20 nt, Artificial Sequence
  targeting sequence with TTCN PAM
cuuucccucucugucccuca

SEQ ID NO: 22703 - RNA, 20 nt, Artificial Sequence
  targeting sequence with TTCN PAM
cucucugucccucaguuucc

SEQ ID NO: 22704 - RNA, 20 nt, Artificial Sequence
  targeting sequence with TTCN PAM
uucucugugaaacuagagug

SEQ ID NO: 22705 - RNA, 20 nt, Artificial Sequence
  targeting sequence with TTCN PAM
cugugaaacuagaguguugg

SEQ ID NO: 22706 - RNA, 20 nt, Artificial Sequence
  targeting sequence with TTCN PAM
cagagaaggaaacugaggga

SEQ ID NO: 22707 - RNA, 20 nt, Artificial Sequence
  targeting sequence with TTCN PAM
cauuggcaaaaauguguuga

SEQ ID NO: 22708 - RNA, 20 nt, Artificial Sequence
  targeting sequence with TTCN PAM
guagcauaaaaauccauacu

SEQ ID NO: 22709 - RNA, 20 nt, Artificial Sequence
  targeting sequence with TTCN PAM
ucaaaucccaaaguauggau

SEQ ID NO: 22710 - RNA, 20 nt, Artificial Sequence
  targeting sequence with TTCN PAM
aagaguucgucaaaucccaa

SEQ ID NO: 22711 - RNA, 20 nt, Artificial Sequence
  targeting sequence with TTCN PAM
gcauccugcugguuguggaa

SEQ ID NO: 22712 - RNA, 20 nt, Artificial Sequence
  targeting sequence with TTCN PAM
acaaccagcaggaugcagaa

SEQ ID NO: 22713 - RNA, 20 nt, Artificial Sequence
  targeting sequence with TTCN PAM
cugcaaaaaguuguugagau

SEQ ID NO: 22714 - RNA, 20 nt, Artificial Sequence
  targeting sequence with TTCN PAM
accaucucaacaacuuuuug

SEQ ID NO: 22715 - RNA, 20 nt, Artificial Sequence
  targeting sequence with TTCN PAM
ucaaccaucucaacaacuuu

SEQ ID NO: 22716 - RNA, 20 nt, Artificial Sequence
  targeting sequence with TTCN PAM
ccugaccucuugcuaaccaa

SEQ ID NO: 22717 - RNA, 20 nt, Artificial Sequence
  targeting sequence with TTCN PAM
aaauuuugccucaucgcaau

SEQ ID NO: 22718 - RNA, 20 nt, Artificial Sequence
  targeting sequence with TTCN PAM
ccacccaccugacugcacau

SEQ ID NO: 22719 - RNA, 20 nt, Artificial Sequence
  targeting sequence with TTCN PAM
ucuccacccaccugacugca

SEQ ID NO: 22720 - RNA, 20 nt, Artificial Sequence
  targeting sequence with TTCN PAM
gugaaccagugccagcugca

SEQ ID NO: 22721 - RNA, 20 nt, Artificial Sequence
  targeting sequence with TTCN PAM
cagaaagggcccaauucuuc

SEQ ID NO: 22722 - RNA, 20 nt, Artificial Sequence
  targeting sequence with TTCN PAM
gugcaucuccucgauuugcu

SEQ ID NO: 22723 - RNA, 20 nt, Artificial Sequence
  targeting sequence with TTCN PAM
caaauguaaucauuucacca

SEQ ID NO: 22724 - RNA, 20 nt, Artificial Sequence
  targeting sequence with TTCN PAM
ccaggaucagacaacuguag

SEQ ID NO: 22725 - RNA, 20 nt, Artificial Sequence
  targeting sequence with TTCN PAM
caaagccaaacuugcaccaa

SEQ ID NO: 22726 - RNA, 20 nt, Artificial Sequence
  targeting sequence with TTCN PAM
caguccagccguggagcugg

SEQ ID NO: 22727 - RNA, 20 nt, Artificial Sequence
  targeting sequence with TTCN PAM
caaucagaugugagguguga

SEQ ID NO: 22728 - RNA, 20 nt, Artificial Sequence
  targeting sequence with TTCN PAM
augcaacaacaacaaaacau

SEQ ID NO: 22729 - RNA, 20 nt, Artificial Sequence
  targeting sequence with TTCN PAM
uauucuaugcaacaacaaca

SEQ ID NO: 22730 - RNA, 20 nt, Artificial Sequence
  targeting sequence with TTCN PAM
aaacgacuauauuuucauuu

SEQ ID NO: 22731 - RNA, 20 nt, Artificial Sequence
  targeting sequence with TTCN PAM
uuuucuaucagcucaugagg

SEQ ID NO: 22732 - RNA, 20 nt, Artificial Sequence
  targeting sequence with TTCN PAM
aucagcucaugaggcaccca

SEQ ID NO: 22733 - RNA, 20 nt, Artificial Sequence
  targeting sequence with TTCN PAM
ccuucccaauuugcuucaaa

SEQ ID NO: 22734 - RNA, 20 nt, Artificial Sequence
  targeting sequence with TTCN PAM
caauuugcuucaaaugccaa

SEQ ID NO: 22735 - RNA, 20 nt, Artificial Sequence
  targeting sequence with TTCN PAM
aaugccaaacaaccguagaa

SEQ ID NO: 22736 - RNA, 20 nt, Artificial Sequence
  targeting sequence with TTCN PAM
acgguuguuuggcauuugaa

SEQ ID NO: 22737 - RNA, 20 nt, Artificial Sequence
  targeting sequence with TTCN PAM
ucggcaacuucuccuguagu

SEQ ID NO: 22738 - RNA, 20 nt, Artificial Sequence
  targeting sequence with TTCN PAM
gcaacuucuccuguaguugu

SEQ ID NO: 22739 - RNA, 20 nt, Artificial Sequence
  targeting sequence with TTCN PAM
ccuguaguugugagaggauc

SEQ ID NO: 22740 - RNA, 20 nt, Artificial Sequence
  targeting sequence with TTCN PAM
augauugcucucgguuguug

SEQ ID NO: 22741 - RNA, 20 nt, Artificial Sequence
  targeting sequence with TTCN PAM
aguggccggccacuaugcuc

SEQ ID NO: 22742 - RNA, 20 nt, Artificial Sequence
  targeting sequence with TTCN PAM
agccucucaucuccuuugca

SEQ ID NO: 22743 - RNA, 20 nt, Artificial Sequence
  targeting sequence with TTCN PAM
ugaaccaccacugcacugua

SEQ ID NO: 22744 - RNA, 20 nt, Artificial Sequence
  targeting sequence with TTCN PAM
agaaguuuugcaaaggagau

SEQ ID NO: 22745 - RNA, 20 nt, Artificial Sequence
  targeting sequence with TTCN PAM
ugggccaaaugcguugucga

SEQ ID NO: 22746 - RNA, 20 nt, Artificial Sequence
  targeting sequence with TTCN PAM
aaaugggucauaaagcaaca

SEQ ID NO: 22747 - RNA, 20 nt, Artificial Sequence
  targeting sequence with TTCN PAM
uauuugaguucaaaaugggu

SEQ ID NO: 22748 - RNA, 20 nt, Artificial Sequence
  targeting sequence with TTCN PAM
agcaguuuucuuauuugagu

SEQ ID NO: 22749 - RNA, 20 nt, Artificial Sequence
  targeting sequence with TTCN PAM
cgcuuuauguuuuuuugcua

SEQ ID NO: 22750 - RNA, 20 nt, Artificial Sequence
  targeting sequence with TTCN PAM
acgggcauuucucgcuuuau

SEQ ID NO: 22751 - RNA, 20 nt, Artificial Sequence
  targeting sequence with TTCN PAM
uaaaugugguuauguuauac

SEQ ID NO: 22752 - RNA, 20 nt, Artificial Sequence
  targeting sequence with TTCN PAM
acuaucaaacagcaaauucc

SEQ ID NO: 22753 - RNA, 20 nt, Artificial Sequence
  targeting sequence with TTCN PAM
agagccaauaugugagucuc

SEQ ID NO: 22754 - RNA, 20 nt, Artificial Sequence
  targeting sequence with TTCN PAM
uagccuuucccucccugucu

SEQ ID NO: 22755 - RNA, 20 nt, Artificial Sequence
  targeting sequence with TTCN PAM
cucccugucuccuuuuagag

SEQ ID NO: 22756 - RNA, 20 nt, Artificial Sequence
  targeting sequence with TTCN PAM
cuaaaaggagacagggaggg

SEQ ID NO: 22757 - RNA, 20 nt, Artificial Sequence
  targeting sequence with TTCN PAM
cuggccuucagcuucuuucu

SEQ ID NO: 22758 - RNA, 20 nt, Artificial Sequence
  targeting sequence with TTCN PAM
gcuucuuucucuauaaaaua

SEQ ID NO: 22759 - RNA, 20 nt, Artificial Sequence
  targeting sequence with TTCN PAM
uucucuauaaaauagggaua

SEQ ID NO: 22760 - RNA, 20 nt, Artificial Sequence
  targeting sequence with TTCN PAM
cuauaaaauagggauaacag

SEQ ID NO: 22761 - RNA, 20 nt, Artificial Sequence
  targeting sequence with TTCN PAM
aauauuaacucgucuaaucc

SEQ ID NO: 22762 - RNA, 20 nt, Artificial Sequence
  targeting sequence with TTCN PAM
cgccagcuuucccugaccug

SEQ ID NO: 22763 - RNA, 20 nt, Artificial Sequence
  targeting sequence with TTCN PAM
cugaccugcucccuccagcu

SEQ ID NO: 22764 - RNA, 20 nt, Artificial Sequence
  targeting sequence with TTCN PAM
cuuuuuucagagaugagguc

SEQ ID NO: 22765 - RNA, 20 nt, Artificial Sequence
  targeting sequence with TTCN PAM
gagaugaggucucugucgcc

SEQ ID NO: 22766 - RNA, 20 nt, Artificial Sequence
  targeting sequence with TTCN PAM
cgccguucuuugaccucuca

SEQ ID NO: 22767 - RNA, 20 nt, Artificial Sequence
  targeting sequence with TTCN PAM
uugaccucucaaaugcccug

SEQ ID NO: 22768 - RNA, 20 nt, Artificial Sequence
  targeting sequence with TTCN PAM
accuugggcauuucuuuccc

SEQ ID NO: 22769 - RNA, 20 nt, Artificial Sequence
  targeting sequence with TTCN PAM
uucccucuaaucugugcuga

SEQ ID NO: 22770 - RNA, 20 nt, Artificial Sequence
  targeting sequence with TTCN PAM
cucuaaucugugcugacuuc

SEQ ID NO: 22771 - RNA, 20 nt, Artificial Sequence
  targeting sequence with TTCN PAM
cagcacauuuuuugccucuu

SEQ ID NO: 22772 - RNA, 20 nt, Artificial Sequence
  targeting sequence with TTCN PAM
caagaggcaaaaaaugugcu

SEQ ID NO: 22773 - RNA, 20 nt, Artificial Sequence
  targeting sequence with TTCN PAM
ugccagacuuucccaagagg

SEQ ID NO: 22774 - RNA, 20 nt, Artificial Sequence
  targeting sequence with TTCN PAM
cacagcagggucaguggucu

SEQ ID NO: 22775 - RNA, 20 nt, Artificial Sequence
  targeting sequence with TTCN PAM
cuuacagucuuuggcuuucc

SEQ ID NO: 22776 - RNA, 20 nt, Artificial Sequence
  targeting sequence with TTCN PAM
ugaaacgagacccccucagg

SEQ ID NO: 22777 - RNA, 20 nt, Artificial Sequence
  targeting sequence with TTCN PAM
ggaaagccaaagacuguaag

SEQ ID NO: 22778 - RNA, 20 nt, Artificial Sequence
  targeting sequence with TTCN PAM
cuccaggugagcaccugaua

SEQ ID NO: 22779 - RNA, 20 nt, Artificial Sequence
  targeting sequence with TTCN PAM
agccuaaguugagucugggc

SEQ ID NO: 22780 - RNA, 20 nt, Artificial Sequence
  targeting sequence with TTCN PAM
cucagacuuuucucucgcug

SEQ ID NO: 22781 - RNA, 20 nt, Artificial Sequence
  targeting sequence with TTCN PAM
cucgcugcucccuguccucu

SEQ ID NO: 22782 - RNA, 20 nt, Artificial Sequence
  targeting sequence with TTCN PAM
ucaccuggggcauggggcug

SEQ ID NO: 22783 - RNA, 20 nt, Artificial Sequence
  targeting sequence with TTCN PAM
gcugggauaagagccagggc

SEQ ID NO: 22784 - RNA, 20 nt, Artificial Sequence
  targeting sequence with TTCN PAM
uucauucaauaaaugccuac

SEQ ID NO: 22785 - RNA, 20 nt, Artificial Sequence
  targeting sequence with TTCN PAM
uucaauaaaugccuacuacg

SEQ ID NO: 22786 - RNA, 20 nt, Artificial Sequence
  targeting sequence with TTCN PAM
auaaaugccuacuacgugac

SEQ ID NO: 22787 - RNA, 20 nt, Artificial Sequence
  targeting sequence with TTCN PAM
ccaccgugucaccaggucuc

SEQ ID NO: 22788 - RNA, 20 nt, Artificial Sequence
  targeting sequence with TTCN PAM
ccugagggauuguccuguuu

SEQ ID NO: 22789 - RNA, 20 nt, Artificial Sequence
  targeting sequence with TTCN PAM
caggccucuaaacguuuccc

SEQ ID NO: 22790 - RNA, 20 nt, Artificial Sequence
  targeting sequence with TTCN PAM
uggaggagguguccucucag

SEQ ID NO: 22791 - RNA, 20 nt, Artificial Sequence
  targeting sequence with TTCN PAM
ggcugagaggacaccuccuc

SEQ ID NO: 22792 - RNA, 20 nt, Artificial Sequence
  targeting sequence with TTCN PAM
cucccuccuucuggcugaga

SEQ ID NO: 22793 - RNA, 20 nt, Artificial Sequence
  targeting sequence with TTCN PAM
cuugccccauuuuuauucuc

SEQ ID NO: 22794 - RNA, 20 nt, Artificial Sequence
  targeting sequence with TTCN PAM
uaauccuccuccacuucacu

SEQ ID NO: 22795 - RNA, 20 nt, Artificial Sequence
  targeting sequence with TTCN PAM
gcauccagggcccagcagag

SEQ ID NO: 22796 - RNA, 20 nt, Artificial Sequence
  targeting sequence with TTCN PAM
gggcaagacuggaaagggaa

SEQ ID NO: 22797 - RNA, 20 nt, Artificial Sequence
  targeting sequence with TTCN PAM
agucuugcccugaaucagug

SEQ ID NO: 22798 - RNA, 20 nt, Artificial Sequence
  targeting sequence with TTCN PAM
cuuuccagucuugcccugaa

SEQ ID NO: 22799 - RNA, 20 nt, Artificial Sequence
  targeting sequence with TTCN PAM
gguccuuccuggauacaugg

SEQ ID NO: 22800 - RNA, 20 nt, Artificial Sequence
  targeting sequence with TTCN PAM
uggauacauggcaucuuucc

SEQ ID NO: 22801 - RNA, 20 nt, Artificial Sequence
  targeting sequence with TTCN PAM
cagaggaaaggacuccccug

SEQ ID NO: 22802 - RNA, 20 nt, Artificial Sequence
  targeting sequence with TTCN PAM
ucugggaaagaugccaugua

SEQ ID NO: 22803 - RNA, 20 nt, Artificial Sequence
  targeting sequence with TTCN PAM
cucugggacguuacuuagcu

SEQ ID NO: 22804 - RNA, 20 nt, Artificial Sequence
  targeting sequence with TTCN PAM
cuaccuagugcaguagaacc

SEQ ID NO: 22805 - RNA, 20 nt, Artificial Sequence
  targeting sequence with TTCN PAM
acugcacuagguagggaagc

SEQ ID NO: 22806 - RNA, 20 nt, Artificial Sequence
  targeting sequence with TTCN PAM
ucuuguucuuacccuggaaa

SEQ ID NO: 22807 - RNA, 20 nt, Artificial Sequence
  targeting sequence with TTCN PAM
uacccuggaaaggauguggu

SEQ ID NO: 22808 - RNA, 20 nt, Artificial Sequence
  targeting sequence with TTCN PAM
aggguaagaacaagaugaac

SEQ ID NO: 22809 - RNA, 20 nt, Artificial Sequence
  targeting sequence with TTCN PAM
uggguucuuggagcuaacaa

SEQ ID NO: 22810 - RNA, 20 nt, Artificial Sequence
  targeting sequence with TTCN PAM
uggagcuaacaaaagguaua

SEQ ID NO: 22811 - RNA, 20 nt, Artificial Sequence
  targeting sequence with TTCN PAM
auaccuuuuguuagcuccaa

SEQ ID NO: 22812 - RNA, 20 nt, Artificial Sequence
  targeting sequence with TTCN PAM
cacguaaauuucuauaccuu

SEQ ID NO: 22813 - RNA, 20 nt, Artificial Sequence
  targeting sequence with TTCN PAM
auuuaguucacacguaaauu

SEQ ID NO: 22814 - RNA, 20 nt, Artificial Sequence
  targeting sequence with TTCN PAM
gagcuuagcauuuucuauuu

SEQ ID NO: 22815 - RNA, 20 nt, Artificial Sequence
  targeting sequence with TTCN PAM
guucagagcuuagcauuuuc

SEQ ID NO: 22816 - RNA, 20 nt, Artificial Sequence
  targeting sequence with TTCN PAM
ucaguucagagcuuagcauu

SEQ ID NO: 22817 - RNA, 20 nt, Artificial Sequence
  targeting sequence with TTCN PAM
gaccaauuagggguuaagcu

SEQ ID NO: 22818 - RNA, 20 nt, Artificial Sequence
  targeting sequence with TTCN PAM
uaagugcucacaagaaagag

SEQ ID NO: 22819 - RNA, 20 nt, Artificial Sequence
  targeting sequence with TTCN PAM
ugugagcacuuaagaagggu

SEQ ID NO: 22820 - RNA, 20 nt, Artificial Sequence
  targeting sequence with TTCN PAM
aauaaagcuuuagaugguga

SEQ ID NO: 22821 - RNA, 20 nt, Artificial Sequence
  targeting sequence with TTCN PAM
aaauaagguauucuuaaccu

SEQ ID NO: 22822 - RNA, 20 nt, Artificial Sequence
  targeting sequence with TTCN PAM
uaaccuuuuguagacccuca

SEQ ID NO: 22823 - RNA, 20 nt, Artificial Sequence
  targeting sequence with TTCN PAM
gugugagggucuacaaaagg

SEQ ID NO: 22824 - RNA, 20 nt, Artificial Sequence
  targeting sequence with TTCN PAM
uuauuugucugcugagcuuc

SEQ ID NO: 22825 - RNA, 20 nt, Artificial Sequence
  targeting sequence with TTCN PAM
ggcagccucuagguacgaag

SEQ ID NO: 22826 - RNA, 20 nt, Artificial Sequence
  targeting sequence with TTCN PAM
uaccuagaggcugccagaag

SEQ ID NO: 22827 - RNA, 20 nt, Artificial Sequence
  targeting sequence with TTCN PAM
cuggcuccuggcauaggcac

SEQ ID NO: 22828 - RNA, 20 nt, Artificial Sequence
  targeting sequence with TTCN PAM
ucaacugcugacccauuucc

SEQ ID NO: 22829 - RNA, 20 nt, Artificial Sequence
  targeting sequence with TTCN PAM
aacagcagcuugacugaugu

SEQ ID NO: 22830 - RNA, 20 nt, Artificial Sequence
  targeting sequence with TTCN PAM
gugcuuuccaacagcagcuu

SEQ ID NO: 22831 - RNA, 20 nt, Artificial Sequence
  targeting sequence with TTCN PAM
ugcuggagagggcuaaaugc

SEQ ID NO: 22832 - RNA, 20 nt, Artificial Sequence
  targeting sequence with TTCN PAM
acagaggcauuuagcccucu

SEQ ID NO: 22833 - RNA, 20 nt, Artificial Sequence
  targeting sequence with TTCN PAM
uauaagccugucuuucaaca

SEQ ID NO: 22834 - RNA, 20 nt, Artificial Sequence
  targeting sequence with TTCN PAM
augcagcuuaggacauaacc

SEQ ID NO: 22835 - RNA, 20 nt, Artificial Sequence
  targeting sequence with TTCN PAM
cuuuuagagcuaauuggaga

SEQ ID NO: 22836 - RNA, 20 nt, Artificial Sequence
  targeting sequence with TTCN PAM
gagaaauggaauaauuacca

SEQ ID NO: 22837 - RNA, 20 nt, Artificial Sequence
  targeting sequence with TTCN PAM
cugaacuacucaaguugucu

SEQ ID NO: 22838 - RNA, 20 nt, Artificial Sequence
  targeting sequence with TTCN PAM
auuucucugaacuacucaag

SEQ ID NO: 22839 - RNA, 20 nt, Artificial Sequence
  targeting sequence with TTCN PAM
aagcuguacugccucuggag

SEQ ID NO: 22840 - RNA, 20 nt, Artificial Sequence
  targeting sequence with TTCN PAM
uccaagcuguacugccucug

SEQ ID NO: 22841 - RNA, 20 nt, Artificial Sequence
  targeting sequence with TTCN PAM
ugggcuuuggaaucagaccu

SEQ ID NO: 22842 - RNA, 20 nt, Artificial Sequence
  targeting sequence with TTCN PAM
aaagcccaagaaugucuuuc

SEQ ID NO: 22843 - RNA, 20 nt, Artificial Sequence
  targeting sequence with TTCN PAM
aacccaggucugauuccaaa

SEQ ID NO: 22844 - RNA, 20 nt, Artificial Sequence
  targeting sequence with TTCN PAM
aguuggugacuugggcaaau

SEQ ID NO: 22845 - RNA, 20 nt, Artificial Sequence
  targeting sequence with TTCN PAM
ucaucaguacugugaggaua

SEQ ID NO: 22846 - RNA, 20 nt, Artificial Sequence
  targeting sequence with TTCN PAM
gagugacaucaacaagagcg

SEQ ID NO: 22847 - RNA, 20 nt, Artificial Sequence
  targeting sequence with TTCN PAM
agagcugcugcugggccagg

SEQ ID NO: 22848 - RNA, 20 nt, Artificial Sequence
  targeting sequence with TTCN PAM
ucaagagcugcugcugggcc

SEQ ID NO: 22849 - RNA, 20 nt, Artificial Sequence
  targeting sequence with TTCN PAM
cucacugcaggaagauccgu

SEQ ID NO: 22850 - RNA, 20 nt, Artificial Sequence
  targeting sequence with TTCN PAM
ugcagugagagaaaagcaaa

SEQ ID NO: 22851 - RNA, 20 nt, Artificial Sequence
  targeting sequence with TTCN PAM
guguccaucguccugaaacu

SEQ ID NO: 22852 - RNA, 20 nt, Artificial Sequence
  targeting sequence with TTCN PAM
ggacgauggacacugaacgg

SEQ ID NO: 22853 - RNA, 20 nt, Artificial Sequence
  targeting sequence with TTCN PAM
acaucuccagguuccugcug

SEQ ID NO: 22854 - RNA, 20 nt, Artificial Sequence
  targeting sequence with TTCN PAM
ugcugcacagccugcccaag

SEQ ID NO: 22855 - RNA, 20 nt, Artificial Sequence
  targeting sequence with TTCN PAM
cuuaucccuccuccguccca

SEQ ID NO: 22856 - RNA, 20 nt, Artificial Sequence
  targeting sequence with TTCN PAM
ugucuaauggccccaagaaa

SEQ ID NO: 22857 - RNA, 20 nt, Artificial Sequence
  targeting sequence with TTCN PAM
uggggccauuagacaagaac

SEQ ID NO: 22858 - RNA, 20 nt, Artificial Sequence
  targeting sequence with TTCN PAM
uuccagagcacuuuccuggc

SEQ ID NO: 22859 - RNA, 20 nt, Artificial Sequence
  targeting sequence with TTCN PAM
agagcacuuuccuggcagaa

SEQ ID NO: 22860 - RNA, 20 nt, Artificial Sequence
  targeting sequence with TTCN PAM
uggcagaaccuuccucucuc

SEQ ID NO: 22861 - RNA, 20 nt, Artificial Sequence
  targeting sequence with TTCN PAM
gccaggaaagugcucuggaa

SEQ ID NO: 22862 - RNA, 20 nt, Artificial Sequence
  targeting sequence with TTCN PAM
ucucucagcaacccucaggg

SEQ ID NO: 22863 - RNA, 20 nt, Artificial Sequence
  targeting sequence with TTCN PAM
cugaggguugcugagagagg

SEQ ID NO: 22864 - RNA, 20 nt, Artificial Sequence
  targeting sequence with TTCN PAM
cugucuucccugaggguugc

SEQ ID NO: 22865 - RNA, 20 nt, Artificial Sequence
  targeting sequence with TTCN PAM
cuuggccugggccccugggc

SEQ ID NO: 22866 - RNA, 20 nt, Artificial Sequence
  targeting sequence with TTCN PAM
gggcucucugagcugaaccc

SEQ ID NO: 22867 - RNA, 20 nt, Artificial Sequence
  targeting sequence with TTCN PAM
gcucagagagcccugaaaac

SEQ ID NO: 22868 - RNA, 20 nt, Artificial Sequence
  targeting sequence with TTCN PAM
aggagggauugggacagugu

SEQ ID NO: 22869 - RNA, 20 nt, Artificial Sequence
  targeting sequence with TTCN PAM
gucacacccucaucuguggg

SEQ ID NO: 22870 - RNA, 20 nt, Artificial Sequence
  targeting sequence with TTCN PAM
auuucagucacacccucauc

SEQ ID NO: 22871 - RNA, 20 nt, Artificial Sequence
  targeting sequence with TTCN PAM
uccauuucagucacacccuc

SEQ ID NO: 22872 - RNA, 20 nt, Artificial Sequence
  targeting sequence with TTCN PAM
ggcuuggaaccuugggcacu

SEQ ID NO: 22873 - RNA, 20 nt, Artificial Sequence
  targeting sequence with TTCN PAM
aagccugaaggccuggugcu

SEQ ID NO: 22874 - RNA, 20 nt, Artificial Sequence
  targeting sequence with TTCN PAM
ccagacuggggaggagggag

SEQ ID NO: 22875 - RNA, 20 nt, Artificial Sequence
  targeting sequence with TTCN PAM
gcccagguauacauagcacc

SEQ ID NO: 22876 - RNA, 20 nt, Artificial Sequence
  targeting sequence with TTCN PAM
gugccccaagcccugggcca

SEQ ID NO: 22877 - RNA, 20 nt, Artificial Sequence
  targeting sequence with TTCN PAM
acccucagacacagcacaca

SEQ ID NO: 22878 - RNA, 20 nt, Artificial Sequence
  targeting sequence with TTCN PAM
uuccacccucagacacagca

SEQ ID NO: 22879 - RNA, 20 nt, Artificial Sequence
  targeting sequence with TTCN PAM
cugaccauggcccugaccuc

SEQ ID NO: 22880 - RNA, 20 nt, Artificial Sequence
  targeting sequence with TTCN PAM
cuggcugccucagcuugcau

SEQ ID NO: 22881 - RNA, 20 nt, Artificial Sequence
  targeting sequence with TTCN PAM
aggggaggacccagcauaug

SEQ ID NO: 22882 - RNA, 20 nt, Artificial Sequence
  targeting sequence with TTCN PAM
ucucuucuguagccaucgag

SEQ ID NO: 22883 - RNA, 20 nt, Artificial Sequence
  targeting sequence with TTCN PAM
guagccaucgagggccacag

SEQ ID NO: 22884 - RNA, 20 nt, Artificial Sequence
  targeting sequence with TTCN PAM
ggcaccugcucugcuuaugg

SEQ ID NO: 22885 - RNA, 20 nt, Artificial Sequence
  targeting sequence with TTCN PAM
uuucuaaaucucacuguacu

SEQ ID NO: 22886 - RNA, 20 nt, Artificial Sequence
  targeting sequence with TTCN PAM
aaaucucacuguacucucag

SEQ ID NO: 22887 - RNA, 20 nt, Artificial Sequence
  targeting sequence with TTCN PAM
cagccgcagccccaccuucc

SEQ ID NO: 22888 - RNA, 20 nt, Artificial Sequence
  targeting sequence with TTCN PAM
cucuguaaggaaaacccacu

SEQ ID NO: 22889 - RNA, 20 nt, Artificial Sequence
  targeting sequence with TTCN PAM
uuacagagggaagguggggc

SEQ ID NO: 22890 - RNA, 20 nt, Artificial Sequence
  targeting sequence with TTCN PAM
ccaguggaguggguuuuccu

SEQ ID NO: 22891 - RNA, 20 nt, Artificial Sequence
  targeting sequence with TTCN PAM
uacaacaaggagcucugggu

SEQ ID NO: 22892 - RNA, 20 nt, Artificial Sequence
  targeting sequence with TTCN PAM
aggcccauuauguacauuuc

SEQ ID NO: 22893 - RNA, 20 nt, Artificial Sequence
  targeting sequence with TTCN PAM
ggggaaauacccucaaauca

SEQ ID NO: 22894 - RNA, 20 nt, Artificial Sequence
  targeting sequence with TTCN PAM
ccugaaauguacauaauggg

SEQ ID NO: 22895 - RNA, 20 nt, Artificial Sequence
  targeting sequence with TTCN PAM
uggagucagaccucugcugc

SEQ ID NO: 22896 - RNA, 20 nt, Artificial Sequence
  targeting sequence with TTCN PAM
ccguaggagcagucagggcu

SEQ ID NO: 22897 - RNA, 20 nt, Artificial Sequence
  targeting sequence with TTCN PAM
agcaaguucuguuugaguca

SEQ ID NO: 22898 - RNA, 20 nt, Artificial Sequence
  targeting sequence with TTCN PAM
guuugagucaacagcuugau

SEQ ID NO: 22899 - RNA, 20 nt, Artificial Sequence
  targeting sequence with TTCN PAM
aucaagcuguugacucaaac

SEQ ID NO: 22900 - RNA, 20 nt, Artificial Sequence
  targeting sequence with TTCN PAM
agguccccaggggauggcac

SEQ ID NO: 22901 - RNA, 20 nt, Artificial Sequence
  targeting sequence with TTCN PAM
gugucuccagcaugacuccu

SEQ ID NO: 22902 - RNA, 20 nt, Artificial Sequence
  targeting sequence with TTCN PAM
uucugugucuccagcaugac

SEQ ID NO: 22903 - RNA, 20 nt, Artificial Sequence
  targeting sequence with TTCN PAM
guggagaguuuccuucugug

SEQ ID NO: 22904 - RNA, 20 nt, Artificial Sequence
  targeting sequence with TTCN PAM
gcaguucuguggagaguuuc

SEQ ID NO: 22905 - RNA, 20 nt, Artificial Sequence
  targeting sequence with TTCN PAM
ugcucccgccgucugcagug

SEQ ID NO: 22906 - RNA, 20 nt, Artificial Sequence
  targeting sequence with TTCN PAM
ucccgcaucucucccagugu

SEQ ID NO: 22907 - RNA, 20 nt, Artificial Sequence
  targeting sequence with TTCN PAM
agggggccccagagcacagg

SEQ ID NO: 22908 - RNA, 20 nt, Artificial Sequence
  targeting sequence with TTCN PAM
gagcggcagccugugcucug

SEQ ID NO: 22909 - RNA, 20 nt, Artificial Sequence
  targeting sequence with TTCN PAM
ccgagggccuggugggcagu

SEQ ID NO: 22910 - RNA, 20 nt, Artificial Sequence
  targeting sequence with TTCN PAM
ugccucaccaaaccugccag

SEQ ID NO: 22911 - RNA, 20 nt, Artificial Sequence
  targeting sequence with TTCN PAM
auuaauacuuuaaccuugcu

SEQ ID NO: 22912 - RNA, 20 nt, Artificial Sequence
  targeting sequence with TTCN PAM
aaagauaaaaacagcguagu

SEQ ID NO: 22913 - RNA, 20 nt, Artificial Sequence
  targeting sequence with TTCN PAM
ugggccuugccauccgagaa

SEQ ID NO: 22914 - RNA, 20 nt, Artificial Sequence
  targeting sequence with TTCN PAM
cggauggcaaggcccaggaa

SEQ ID NO: 22915 - RNA, 20 nt, Artificial Sequence
  targeting sequence with TTCN PAM
ucacggucuuuccucugccu

SEQ ID NO: 22916 - RNA, 20 nt, Artificial Sequence
  targeting sequence with TTCN PAM
ucugccuucccggcaccagc

SEQ ID NO: 22917 - RNA, 20 nt, Artificial Sequence
  targeting sequence with TTCN PAM
cggcaccagcacaagcugug

SEQ ID NO: 22918 - RNA, 20 nt, Artificial Sequence
  targeting sequence with TTCN PAM
agccuggggcucacuccaag

SEQ ID NO: 22919 - RNA, 20 nt, Artificial Sequence
  targeting sequence with TTCN PAM
cggcaggaaaauacucuuca

SEQ ID NO: 22920 - RNA, 20 nt, Artificial Sequence
  targeting sequence with TTCN PAM
ugccgugaacaggguuaagg

SEQ ID NO: 22921 - RNA, 20 nt, Artificial Sequence
  targeting sequence with TTCN PAM
ccuuggccaagcagagcaag

SEQ ID NO: 22922 - RNA, 20 nt, Artificial Sequence
  targeting sequence with TTCN PAM
aaaaguccauugagcugggu

SEQ ID NO: 22923 - RNA, 20 nt, Artificial Sequence
  targeting sequence with TTCN PAM
acgacagugaggugaggaug

SEQ ID NO: 22924 - RNA, 20 nt, Artificial Sequence
  targeting sequence with TTCN PAM
ccucucccuugaggccaucu

SEQ ID NO: 22925 - RNA, 20 nt, Artificial Sequence
  targeting sequence with TTCN PAM
ugccuggccuggguuccguu

SEQ ID NO: 22926 - RNA, 20 nt, Artificial Sequence
  targeting sequence with TTCN PAM
guuugaagagagacagcugc

SEQ ID NO: 22927 - RNA, 20 nt, Artificial Sequence
  targeting sequence with TTCN PAM
aacggaacccaggccaggca

SEQ ID NO: 22928 - RNA, 20 nt, Artificial Sequence
  targeting sequence with TTCN PAM
cuguccaccuccuguucucc

SEQ ID NO: 22929 - RNA, 20 nt, Artificial Sequence
  targeting sequence with TTCN PAM
ccccgcaguccaccuggcgc

SEQ ID NO: 22930 - RNA, 20 nt, Artificial Sequence
  targeting sequence with TTCN PAM
agaguaagagucagcucugg

SEQ ID NO: 22931 - RNA, 20 nt, Artificial Sequence
  targeting sequence with TTCN PAM
ggaaccaggcuguaguucuc

SEQ ID NO: 22932 - RNA, 20 nt, Artificial Sequence
  targeting sequence with TTCN PAM
agaaagggcagagguuucua

SEQ ID NO: 22933 - RNA, 20 nt, Artificial Sequence
  targeting sequence with TTCN PAM
ccagcaaaucuaccccacac

SEQ ID NO: 22934 - RNA, 20 nt, Artificial Sequence
  targeting sequence with TTCN PAM
uucaacccagccagcuuccu

SEQ ID NO: 22935 - RNA, 20 nt, Artificial Sequence
  targeting sequence with TTCN PAM
acccagccagcuuccuucuu

SEQ ID NO: 22936 - RNA, 20 nt, Artificial Sequence
  targeting sequence with TTCN PAM
uucuuucacacauccucccu

SEQ ID NO: 22937 - RNA, 20 nt, Artificial Sequence
  targeting sequence with TTCN PAM
uucacacauccucccucaag

SEQ ID NO: 22938 - RNA, 20 nt, Artificial Sequence
  targeting sequence with TTCN PAM
cacauccucccucaagcuca

SEQ ID NO: 22939 - RNA, 20 nt, Artificial Sequence
  targeting sequence with TTCN PAM
gacagaccuggguucacauc

SEQ ID NO: 22940 - RNA, 20 nt, Artificial Sequence
  targeting sequence with TTCN PAM
caucccggcuccacccucuc

SEQ ID NO: 22941 - RNA, 20 nt, Artificial Sequence
  targeting sequence with TTCN PAM
gcaccuuggguucccccuuu

SEQ ID NO: 22942 - RNA, 20 nt, Artificial Sequence
  targeting sequence with TTCN PAM
cccuuucccacagguaguug

SEQ ID NO: 22943 - RNA, 20 nt, Artificial Sequence
  targeting sequence with TTCN PAM
cacagguaguugugaggcua

SEQ ID NO: 22944 - RNA, 20 nt, Artificial Sequence
  targeting sequence with TTCN PAM
ugccaggggaaaagugccgu

SEQ ID NO: 22945 - RNA, 20 nt, Artificial Sequence
  targeting sequence with TTCN PAM
ccuggcaggaaugacagugg

SEQ ID NO: 22946 - RNA, 20 nt, Artificial Sequence
  targeting sequence with TTCN PAM
gcaggccuuuauccugcuuc

SEQ ID NO: 22947 - RNA, 20 nt, Artificial Sequence
  targeting sequence with TTCN PAM
ccauggcauggagcuccugg

SEQ ID NO: 22948 - RNA, 20 nt, Artificial Sequence
  targeting sequence with TTCN PAM
cugccugcccacccgggugg

SEQ ID NO: 22949 - RNA, 20 nt, Artificial Sequence
  targeting sequence with TTCN PAM
ucuuggcagccaggccccag

SEQ ID NO: 22950 - RNA, 20 nt, Artificial Sequence
  targeting sequence with TTCN PAM
ggccccuggggccuggcugc

SEQ ID NO: 22951 - RNA, 20 nt, Artificial Sequence
  targeting sequence with TTCN PAM
ucuucuccgccucuuccuac

SEQ ID NO: 22952 - RNA, 20 nt, Artificial Sequence
  targeting sequence with TTCN PAM
ccgccucuuccuacggugag

SEQ ID NO: 22953 - RNA, 20 nt, Artificial Sequence
  targeting sequence with TTCN PAM
uacggugagucccugcaucc

SEQ ID NO: 22954 - RNA, 20 nt, Artificial Sequence
  targeting sequence with TTCN PAM
gaggccuuuggcccuugccc

SEQ ID NO: 22955 - RNA, 20 nt, Artificial Sequence
  targeting sequence with TTCN PAM
uaaacagggacauucagagg

SEQ ID NO: 22956 - RNA, 20 nt, Artificial Sequence
  targeting sequence with TTCN PAM
cagagauaggacccacugcu

SEQ ID NO: 22957 - RNA, 20 nt, Artificial Sequence
  targeting sequence with TTCN PAM
gcuuugggcagcaguggguc

SEQ ID NO: 22958 - RNA, 20 nt, Artificial Sequence
  targeting sequence with TTCN PAM
cagagugggugcuucagcuu

SEQ ID NO: 22959 - RNA, 20 nt, Artificial Sequence
  targeting sequence with TTCN PAM
ggggcauuugguuauguaaa

SEQ ID NO: 22960 - RNA, 20 nt, Artificial Sequence
  targeting sequence with TTCN PAM
gaccaggaggcugagauagg

SEQ ID NO: 22961 - RNA, 20 nt, Artificial Sequence
  targeting sequence with TTCN PAM
gauccucugucaacaucaaa

SEQ ID NO: 22962 - RNA, 20 nt, Artificial Sequence
  targeting sequence with TTCN PAM
caggagcugagcagaggcca

SEQ ID NO: 22963 - RNA, 20 nt, Artificial Sequence
  targeting sequence with TTCN PAM
guaugugugugugugcaggg

SEQ ID NO: 22964 - RNA, 20 nt, Artificial Sequence
  targeting sequence with TTCN PAM
gggacagucugugugugugu

SEQ ID NO: 22965 - RNA, 20 nt, Artificial Sequence
  targeting sequence with TTCN PAM
gugugugugugugcaggggc

SEQ ID NO: 22966 - RNA, 20 nt, Artificial Sequence
  targeting sequence with TTCN PAM
guguguguguguaggggcag

SEQ ID NO: 22967 - RNA, 20 nt, Artificial Sequence
  targeting sequence with TTCN PAM
gugugugugugugugcaggg

SEQ ID NO: 22968 - RNA, 20 nt, Artificial Sequence
  targeting sequence with TTCN PAM
gugugugugugugugcaggg

SEQ ID NO: 22969 - RNA, 20 nt, Artificial Sequence
  targeting sequence with TTCN PAM
ugcuuuuggugaagcugcca

SEQ ID NO: 22970 - RNA, 20 nt, Artificial Sequence
  targeting sequence with TTCN PAM
ccaaaagcaagaagaggcag

SEQ ID NO: 22971 - RNA, 20 nt, Artificial Sequence
  targeting sequence with TTCN PAM
caacccacuggcagcuucac

SEQ ID NO: 22972 - RNA, 20 nt, Artificial Sequence
  targeting sequence with TTCN PAM
cuaugcccuccagacgugcu

SEQ ID NO: 22973 - RNA, 20 nt, Artificial Sequence
  targeting sequence with TTCN PAM
accuggaggaagggaucacu

SEQ ID NO: 22974 - RNA, 20 nt, Artificial Sequence
  targeting sequence with TTCN PAM
uccagguagaacucaaccag

SEQ ID NO: 22975 - RNA, 20 nt, Artificial Sequence
  targeting sequence with TTCN PAM
ucagugaucccuuccuccag

SEQ ID NO: 22976 - RNA, 20 nt, Artificial Sequence
  targeting sequence with TTCN PAM
ucaucagugaucccuuccuc

SEQ ID NO: 22977 - RNA, 20 nt, Artificial Sequence
  targeting sequence with TTCN PAM
cgccuguccccagaccccuc

SEQ ID NO: 22978 - RNA, 20 nt, Artificial Sequence
  targeting sequence with TTCN PAM
cagagagauuggagaggccc

SEQ ID NO: 22979 - RNA, 20 nt, Artificial Sequence
  targeting sequence with TTCN PAM
ggguccuuaggcccuggcca

SEQ ID NO: 22980 - RNA, 20 nt, Artificial Sequence
  targeting sequence with TTCN PAM
cgugugggucucccacccuc

SEQ ID NO: 22981 - RNA, 20 nt, Artificial Sequence
  targeting sequence with TTCN PAM
acucaagucacuuucgcaug

SEQ ID NO: 22982 - RNA, 20 nt, Artificial Sequence
  targeting sequence with TTCN PAM
caugcaagugacagagucca

SEQ ID NO: 22983 - RNA, 20 nt, Artificial Sequence
  targeting sequence with TTCN PAM
gcuugucaguuuuggacucu

SEQ ID NO: 22984 - RNA, 20 nt, Artificial Sequence
  targeting sequence with TTCN PAM
uugcacacccuuugcuuguu

SEQ ID NO: 22985 - RNA, 20 nt, Artificial Sequence
  targeting sequence with TTCN PAM
ucuccugcuuggggcuuccu

SEQ ID NO: 22986 - RNA, 20 nt, Artificial Sequence
  targeting sequence with TTCN PAM
uggcccagcgcucagucugg

SEQ ID NO: 22987 - RNA, 20 nt, Artificial Sequence
  targeting sequence with TTCN PAM
uucuuuggcagccccguggu

SEQ ID NO: 22988 - RNA, 20 nt, Artificial Sequence
  targeting sequence with TTCN PAM
uuggcagccccguggugccc

SEQ ID NO: 22989 - RNA, 20 nt, Artificial Sequence
  targeting sequence with TTCN PAM
gggggcuauaaggcugaggg

SEQ ID NO: 22990 - RNA, 20 nt, Artificial Sequence
  targeting sequence with TTCN PAM
ucucagcuguggcagugaaa

SEQ ID NO: 22991 - RNA, 20 nt, Artificial Sequence
  targeting sequence with TTCN PAM
cugccacagcugagaggaaa

SEQ ID NO: 22992 - RNA, 20 nt, Artificial Sequence
  targeting sequence with TTCN PAM
ggcagggaacagcacacacg

SEQ ID NO: 22993 - RNA, 20 nt, Artificial Sequence
  targeting sequence with TTCN PAM
cugccagaagccccucccau

SEQ ID NO: 22994 - RNA, 20 nt, Artificial Sequence
  targeting sequence with TTCN PAM
uugcagcucccaggugcugc

SEQ ID NO: 22995 - RNA, 20 nt, Artificial Sequence
  targeting sequence with TTCN PAM
cuccucccaguguggccccu

SEQ ID NO: 22996 - RNA, 20 nt, Artificial Sequence
  targeting sequence with TTCN PAM
gcaagcagcucucugagcuu

SEQ ID NO: 22997 - RNA, 20 nt, Artificial Sequence
  targeting sequence with TTCN PAM
uucagcaagcagcucucuga

SEQ ID NO: 22998 - RNA, 20 nt, Artificial Sequence
  targeting sequence with TTCN PAM
agggaccuccaggugagucu

SEQ ID NO: 22999 - RNA, 20 nt, Artificial Sequence
  targeting sequence with TTCN PAM
guggcugcugggggucugcg

SEQ ID NO: 23000 - RNA, 20 nt, Artificial Sequence
  targeting sequence with TTCN PAM
ccaggaucccugggcccauc

SEQ ID NO: 23001 - RNA, 20 nt, Artificial Sequence
  targeting sequence with TTCN PAM
cacuggcccugggagcuaug

SEQ ID NO: 23002 - RNA, 20 nt, Artificial Sequence
  targeting sequence with TTCN PAM
ccucgcaggccacacacacc

SEQ ID NO: 23003 - RNA, 20 nt, Artificial Sequence
  targeting sequence with TTCN PAM
uucugauuccuuggccugag

SEQ ID NO: 23004 - RNA, 20 nt, Artificial Sequence
  targeting sequence with TTCN PAM
gauuccuuggccugagcccc

SEQ ID NO: 23005 - RNA, 20 nt, Artificial Sequence
  targeting sequence with TTCN PAM
uuggccugagcccccucugu

SEQ ID NO: 23006 - RNA, 20 nt, Artificial Sequence
  targeting sequence with TTCN PAM
uccaccuggaaaacucuucc

SEQ ID NO: 23007 - RNA, 20 nt, Artificial Sequence
  targeting sequence with TTCN PAM
agguggaggaacagaggggg

SEQ ID NO: 23008 - RNA, 20 nt, Artificial Sequence
  targeting sequence with TTCN PAM
acuggucuggcugcccuuga

SEQ ID NO: 23009 - RNA, 20 nt, Artificial Sequence
  targeting sequence with TTCN PAM
cacagggguguaggguggag

SEQ ID NO: 23010 - RNA, 20 nt, Artificial Sequence
  targeting sequence with TTCN PAM
gauuccauccuugaccagau

SEQ ID NO: 23011 - RNA, 20 nt, Artificial Sequence
  targeting sequence with TTCN PAM
auccuugaccagaucccucc

SEQ ID NO: 23012 - RNA, 20 nt, Artificial Sequence
  targeting sequence with TTCN PAM
gcggcuaguggagaccaagg

SEQ ID NO: 23013 - RNA, 20 nt, Artificial Sequence
  targeting sequence with TTCN PAM
cagcuaagcugagcuuugag

SEQ ID NO: 23014 - RNA, 20 nt, Artificial Sequence
  targeting sequence with TTCN PAM
ccugugcacauggggacccu

SEQ ID NO: 23015 - RNA, 20 nt, Artificial Sequence
  targeting sequence with TTCN PAM
ggccaauccuccuccaccac

SEQ ID NO: 23016 - RNA, 20 nt, Artificial Sequence
  targeting sequence with TTCN PAM
agaugugguggcacgaagga

SEQ ID NO: 23017 - RNA, 20 nt, Artificial Sequence
  targeting sequence with TTCN PAM
ugccaccacaucuggaaguu

SEQ ID NO: 23018 - RNA, 20 nt, Artificial Sequence
  targeting sequence with TTCN PAM
uguggggugugggagccaug

SEQ ID NO: 23019 - RNA, 20 nt, Artificial Sequence
  targeting sequence with TTCN PAM
gcucuggugggaggagcuug

SEQ ID NO: 23020 - RNA, 20 nt, Artificial Sequence
  targeting sequence with TTCN PAM
uaaacccaggugacccuaac

SEQ ID NO: 23021 - RNA, 20 nt, Artificial Sequence
  targeting sequence with TTCN PAM
aggaucauaauccacacaga

SEQ ID NO: 23022 - RNA, 20 nt, Artificial Sequence
  targeting sequence with TTCN PAM
cgcccacccugcagcaaggu

SEQ ID NO: 23023 - RNA, 20 nt, Artificial Sequence
  targeting sequence with TTCN PAM
ugccagugguggugagccgg

SEQ ID NO: 23024 - RNA, 20 nt, Artificial Sequence
  targeting sequence with TTCN PAM
gcucacugcugccugacgcc

SEQ ID NO: 23025 - RNA, 20 nt, Artificial Sequence
  targeting sequence with TTCN PAM
agguagguggccacccuggu

SEQ ID NO: 23026 - RNA, 20 nt, Artificial Sequence
  targeting sequence with TTCN PAM
cuuggccacuuuucccuugc

SEQ ID NO: 23027 - RNA, 20 nt, Artificial Sequence
  targeting sequence with TTCN PAM
cuugcccaaaugucccucug

SEQ ID NO: 23028 - RNA, 20 nt, Artificial Sequence
  targeting sequence with TTCN PAM
augugcaucuaaaguggacu

SEQ ID NO: 23029 - RNA, 20 nt, Artificial Sequence
  targeting sequence with TTCN PAM
cuggccccugcgcuguccac

SEQ ID NO: 23030 - RNA, 20 nt, Artificial Sequence
  targeting sequence with TTCN PAM
cucagaaaacaagaaacccc

SEQ ID NO: 23031 - RNA, 20 nt, Artificial Sequence
  targeting sequence with TTCN PAM
gagugaaggucaagggcaca

SEQ ID NO: 23032 - RNA, 20 nt, Artificial Sequence
  targeting sequence with TTCN PAM
uguuuucugagugaagguca

SEQ ID NO: 23033 - RNA, 20 nt, Artificial Sequence
  targeting sequence with TTCN PAM
agcccucaaacaaaggugcu

SEQ ID NO: 23034 - RNA, 20 nt, Artificial Sequence
  targeting sequence with TTCN PAM
gccuggucuuacagcugucu

SEQ ID NO: 23035 - RNA, 20 nt, Artificial Sequence
  targeting sequence with TTCN PAM
cuuagauguuccauucugag

SEQ ID NO: 23036 - RNA, 20 nt, Artificial Sequence
  targeting sequence with TTCN PAM
auucugaggacuaugaguug

SEQ ID NO: 23037 - RNA, 20 nt, Artificial Sequence
  targeting sequence with TTCN PAM
gaggacuaugaguugcuggu

SEQ ID NO: 23038 - RNA, 20 nt, Artificial Sequence
  targeting sequence with TTCN PAM
gcauggcugcugccccuacu

SEQ ID NO: 23039 - RNA, 20 nt, Artificial Sequence
  targeting sequence with TTCN PAM
cagcccagcagaccccaagg

SEQ ID NO: 23040 - RNA, 20 nt, Artificial Sequence
  targeting sequence with TTCN PAM
ccuucacagcccagcagacc

SEQ ID NO: 23041 - RNA, 20 nt, Artificial Sequence
  targeting sequence with TTCN PAM
gacaguuuaacucuuuauuc

SEQ ID NO: 23042 - RNA, 20 nt, Artificial Sequence
  targeting sequence with TTCN PAM
ugcccagaugaaguuugugu

SEQ ID NO: 23043 - RNA, 20 nt, Artificial Sequence
  targeting sequence with TTCN PAM
ucugggcaagaaacacauuc

SEQ ID NO: 23044 - RNA, 20 nt, Artificial Sequence
  targeting sequence with TTCN PAM
gugguuacacaaggcccccc

SEQ ID NO: 23045 - RNA, 20 nt, Artificial Sequence
  targeting sequence with TTCN PAM
uauuuauggcauuucaugcc

SEQ ID NO: 23046 - RNA, 20 nt, Artificial Sequence
  targeting sequence with TTCN PAM
ugccuuguaaauagcaccag

SEQ ID NO: 23047 - RNA, 20 nt, Artificial Sequence
  targeting sequence with TTCN PAM
ucaucuccuggugcuauuua

SEQ ID NO: 23048 - RNA, 20 nt, Artificial Sequence
  targeting sequence with TTCN PAM
cuuccucaucuccuggugcu

SEQ ID NO: 23049 - RNA, 20 nt, Artificial Sequence
  targeting sequence with TTCN PAM
aaggaaaaaaaucuguuacu

SEQ ID NO: 23050 - RNA, 20 nt, Artificial Sequence
  targeting sequence with TTCN PAM
uuagaaaauauauguacauu

SEQ ID NO: 23051 - RNA, 20 nt, Artificial Sequence
  targeting sequence with TTCN PAM
gaacggcuccgaguuguucg

SEQ ID NO: 23052 - RNA, 20 nt, Artificial Sequence
  targeting sequence with TTCN PAM
gaaaguaacagauuuuuuuc

SEQ ID NO: 23053 - RNA, 20 nt, Artificial Sequence
  targeting sequence with TTCN PAM
uggcagccugcuggaguccg

SEQ ID NO: 23054 - RNA, 20 nt, Artificial Sequence
  targeting sequence with TTCN PAM
ucagcaucuacauuuuagca

SEQ ID NO: 23055 - RNA, 20 nt, Artificial Sequence
  targeting sequence with TTCN PAM
guaugcaaaagugcaccugu

SEQ ID NO: 23056 - RNA, 20 nt, Artificial Sequence
  targeting sequence with TTCN PAM
aauuugaaaggaacauuaca

SEQ ID NO: 23057 - RNA, 20 nt, Artificial Sequence
  targeting sequence with TTCN PAM
aauuagaaacaggugcacuu

SEQ ID NO: 23058 - RNA, 20 nt, Artificial Sequence
  targeting sequence with TTCN PAM
uuucaaauuagaaacaggug

SEQ ID NO: 23059 - RNA, 20 nt, Artificial Sequence
  targeting sequence with TTCN PAM
auauugccauuuugauuaaa

SEQ ID NO: 23060 - RNA, 20 nt, Artificial Sequence
  targeting sequence with TTCN PAM
cuugucaagauggaucccca

SEQ ID NO: 23061 - RNA, 20 nt, Artificial Sequence
  targeting sequence with TTCN PAM
uuggacccacguauuuucuc

SEQ ID NO: 23062 - RNA, 20 nt, Artificial Sequence
  targeting sequence with TTCN PAM
auccaccuuccccagcccca

SEQ ID NO: 23063 - RNA, 20 nt, Artificial Sequence
  targeting sequence with TTCN PAM
ccagccccacagagcagccc

SEQ ID NO: 23064 - RNA, 20 nt, Artificial Sequence
  targeting sequence with TTCN PAM
cuuuggaacagcuccuuaag

SEQ ID NO: 23065 - RNA, 20 nt, Artificial Sequence
  targeting sequence with TTCN PAM
aaagggaagagucuccauug

SEQ ID NO: 23066 - RNA, 20 nt, Artificial Sequence
  targeting sequence with TTCN PAM
guuugagauuccagacugcc

SEQ ID NO: 23067 - RNA, 20 nt, Artificial Sequence
  targeting sequence with TTCN PAM
agacugccaaggucuguucc

SEQ ID NO: 23068 - RNA, 20 nt, Artificial Sequence
  targeting sequence with TTCN PAM
cucaggcaucacuggugucc

SEQ ID NO: 23069 - RNA, 20 nt, Artificial Sequence
  targeting sequence with TTCN PAM
augcccucaagcuguuggac

SEQ ID NO: 23070 - RNA, 20 nt, Artificial Sequence
  targeting sequence with TTCN PAM
uuccaugcccucaagcuguu

SEQ ID NO: 23071 - RNA, 20 nt, Artificial Sequence
  targeting sequence with TTCN PAM
gugugcuguuccuuccaugc

SEQ ID NO: 23072 - RNA, 20 nt, Artificial Sequence
  targeting sequence with TTCN PAM
ccuuagcuucugugugcugu

SEQ ID NO: 23073 - RNA, 20 nt, Artificial Sequence
  targeting sequence with TTCN PAM
augcugucucaggccucuca

SEQ ID NO: 23074 - RNA, 20 nt, Artificial Sequence
  targeting sequence with TTCN PAM
cagggcugcugagaggccug

SEQ ID NO: 23075 - RNA, 20 nt, Artificial Sequence
  targeting sequence with TTCN PAM
uucacagggcugcugagagg

SEQ ID NO: 23076 - RNA, 20 nt, Artificial Sequence
  targeting sequence with TTCN PAM
aguggggcugggaagggggu

SEQ ID NO: 23077 - RNA, 20 nt, Artificial Sequence
  targeting sequence with TTCN PAM
cagccccacuggaaaucaua

SEQ ID NO: 23078 - RNA, 20 nt, Artificial Sequence
  targeting sequence with TTCN PAM
cccccaguccaccugccaga

SEQ ID NO: 23079 - RNA, 20 nt, Artificial Sequence
  targeting sequence with TTCN PAM
ugaaaagcccaagaacagcu

SEQ ID NO: 23080 - RNA, 20 nt, Artificial Sequence
  targeting sequence with TTCN PAM
ugaagugcugcauugccacc

SEQ ID NO: 23081 - RNA, 20 nt, Artificial Sequence
  targeting sequence with TTCN PAM
ugggcuuuucaugaagugcu

SEQ ID NO: 23082 - RNA, 20 nt, Artificial Sequence
  targeting sequence with TTCN PAM
gcauggcaugacagcccaca

SEQ ID NO: 23083 - RNA, 20 nt, Artificial Sequence
  targeting sequence with TTCN PAM
uuacaaccuaccugugcagg

SEQ ID NO: 23084 - RNA, 20 nt, Artificial Sequence
  targeting sequence with TTCN PAM
cacugggggccucugcagcc

SEQ ID NO: 23085 - RNA, 20 nt, Artificial Sequence
  targeting sequence with TTCN PAM
uccaucaucuccagagagau

SEQ ID NO: 23086 - RNA, 20 nt, Artificial Sequence
  targeting sequence with TTCN PAM
uuauuuuccuccaucaucuc

SEQ ID NO: 23087 - RNA, 20 nt, Artificial Sequence
  targeting sequence with TTCN PAM
guuggcacaacugucuggcu

SEQ ID NO: 23088 - RNA, 20 nt, Artificial Sequence
  targeting sequence with TTCN PAM
auuagcgcaugacuucaacu

SEQ ID NO: 23089 - RNA, 20 nt, Artificial Sequence
  targeting sequence with TTCN PAM
acugaaaucauuugcauaug

SEQ ID NO: 23090 - RNA, 20 nt, Artificial Sequence
  targeting sequence with TTCN PAM
guugaagucaugcgcuaaug

SEQ ID NO: 23091 - RNA, 20 nt, Artificial Sequence
  targeting sequence with TTCN PAM
cagccauaugcaaaugauuu

SEQ ID NO: 23092 - RNA, 20 nt, Artificial Sequence
  targeting sequence with TTCN PAM
cccucuccccuuuuucccag

SEQ ID NO: 23093 - RNA, 20 nt, Artificial Sequence
  targeting sequence with TTCN PAM
agccgagacuccagcaugca

SEQ ID NO: 23094 - RNA, 20 nt, Artificial Sequence
  targeting sequence with TTCN PAM
gcugaggggaugcaugcugg

SEQ ID NO: 23095 - RNA, 20 nt, Artificial Sequence
  targeting sequence with TTCN PAM
ucggcugaggggaugcaugc

SEQ ID NO: 23096 - RNA, 20 nt, Artificial Sequence
  targeting sequence with TTCN PAM
uggggcagcagagcccggca

SEQ ID NO: 23097 - RNA, 20 nt, Artificial Sequence
  targeting sequence with TTCN PAM
uucagaugcacuuuccgugc

SEQ ID NO: 23098 - RNA, 20 nt, Artificial Sequence
  targeting sequence with TTCN PAM
gaugcacuuuccgugcauca

SEQ ID NO: 23099 - RNA, 20 nt, Artificial Sequence
  targeting sequence with TTCN PAM
gugcaucauccaaggcugcc

SEQ ID NO: 23100 - RNA, 20 nt, Artificial Sequence
  targeting sequence with TTCN PAM
uucagcaaauaugcauuaag

SEQ ID NO: 23101 - RNA, 20 nt, Artificial Sequence
  targeting sequence with TTCN PAM
gcaaauaugcauuaagccaa

SEQ ID NO: 23102 - RNA, 20 nt, Artificial Sequence
  targeting sequence with TTCN PAM
cucucagccugaucuggguc

SEQ ID NO: 23103 - RNA, 20 nt, Artificial Sequence
  targeting sequence with TTCN PAM
gacccagaucaggcugagag

SEQ ID NO: 23104 - RNA, 20 nt, Artificial Sequence
  targeting sequence with TTCN PAM
ccaaggcuguuuccccaucu

SEQ ID NO: 23105 - RNA, 20 nt, Artificial Sequence
  targeting sequence with TTCN PAM
ccaucugcacaaaagggccc

SEQ ID NO: 23106 - RNA, 20 nt, Artificial Sequence
  targeting sequence with TTCN PAM
agccucagucugcgucugug

SEQ ID NO: 23107 - RNA, 20 nt, Artificial Sequence
  targeting sequence with TTCN PAM
cagacgcagacugaggcugg

SEQ ID NO: 23108 - RNA, 20 nt, Artificial Sequence
  targeting sequence with TTCN PAM
uugucacaggcacuugaggg

SEQ ID NO: 23109 - RNA, 20 nt, Artificial Sequence
  targeting sequence with TTCN PAM
augggcaucaccaggucccu

SEQ ID NO: 23110 - RNA, 20 nt, Artificial Sequence
  targeting sequence with TTCN PAM
gcagcugcuccucucuggcc

SEQ ID NO: 23111 - RNA, 20 nt, Artificial Sequence
  targeting sequence with TTCN PAM
ggccuuuagccuguaguccc

SEQ ID NO: 23112 - RNA, 20 nt, Artificial Sequence
  targeting sequence with TTCN PAM
accucagccuccugaguagu

SEQ ID NO: 23113 - RNA, 20 nt, Artificial Sequence
  targeting sequence with TTCN PAM
uguccuuggcucaauugauc

SEQ ID NO: 23114 - RNA, 20 nt, Artificial Sequence
  targeting sequence with TTCN PAM
aggcugcaguaagcuaugau

SEQ ID NO: 23115 - RNA, 20 nt, Artificial Sequence
  targeting sequence with TTCN PAM
ucucuaaacaacauuuaaaa

SEQ ID NO: 23116 - RNA, 20 nt, Artificial Sequence
  targeting sequence with TTCN PAM
uaaaacaauuuuuaaauguu

SEQ ID NO: 23117 - RNA, 20 nt, Artificial Sequence
  targeting sequence with TTCN PAM
guuuuuacacagccauuacg

SEQ ID NO: 23118 - RNA, 20 nt, Artificial Sequence
  targeting sequence with TTCN PAM
uggaaggaggaaguaaggga

SEQ ID NO: 23119 - RNA, 20 nt, Artificial Sequence
  targeting sequence with TTCN PAM
aagaacaugggcacaauguu

SEQ ID NO: 23120 - RNA, 20 nt, Artificial Sequence
  targeting sequence with TTCN PAM
uccuuccaagaacaugggca

SEQ ID NO: 23121 - RNA, 20 nt, Artificial Sequence
  targeting sequence with TTCN PAM
caucuguccccagcaaggcu

SEQ ID NO: 23122 - RNA, 20 nt, Artificial Sequence
  targeting sequence with TTCN PAM
cagccuugcuggggacagau

SEQ ID NO: 23123 - RNA, 20 nt, Artificial Sequence
  targeting sequence with TTCN PAM
cuggcuuggagucugugugc

SEQ ID NO: 23124 - RNA, 20 nt, Artificial Sequence
  targeting sequence with TTCN PAM
cccccugcagauccagaaca

SEQ ID NO: 23125 - RNA, 20 nt, Artificial Sequence
  targeting sequence with TTCN PAM
ggaucugcagggggagaauc

SEQ ID NO: 23126 - RNA, 20 nt, Artificial Sequence
  targeting sequence with TTCN PAM
gccaacacccagaccccuag

SEQ ID NO: 23127 - RNA, 20 nt, Artificial Sequence
  targeting sequence with TTCN PAM
cccagucccagugcuguggg

SEQ ID NO: 23128 - RNA, 20 nt, Artificial Sequence
  targeting sequence with TTCN PAM
gaucaguacccccugagacu

SEQ ID NO: 23129 - RNA, 20 nt, Artificial Sequence
  targeting sequence with TTCN PAM
aggggcucccagucucaggg

SEQ ID NO: 23130 - RNA, 20 nt, Artificial Sequence
  targeting sequence with TTCN PAM
ugcuuucaaggggcucccag

SEQ ID NO: 23131 - RNA, 20 nt, Artificial Sequence
  targeting sequence with TTCN PAM
acccuagcauuugccaaacu

SEQ ID NO: 23132 - RNA, 20 nt, Artificial Sequence
  targeting sequence with TTCN PAM
cuuuucuacccuagcauuug

SEQ ID NO: 23133 - RNA, 20 nt, Artificial Sequence
  targeting sequence with TTCN PAM
ucuuucucuuuucuacccua

SEQ ID NO: 23134 - RNA, 20 nt, Artificial Sequence
  targeting sequence with TTCN PAM
cuccuuccucuuucucuuuu

SEQ ID NO: 23135 - RNA, 20 nt, Artificial Sequence
  targeting sequence with TTCN PAM
cccucccuuauucccccuug

SEQ ID NO: 23136 - RNA, 20 nt, Artificial Sequence
  targeting sequence with TTCN PAM
cccuugaugcucucaguacc

SEQ ID NO: 23137 - RNA, 20 nt, Artificial Sequence
  targeting sequence with TTCN PAM
gcgguacugagagcaucaag

SEQ ID NO: 23138 - RNA, 20 nt, Artificial Sequence
  targeting sequence with TTCN PAM
ccuggucccccacauggcuc

SEQ ID NO: 23139 - RNA, 20 nt, Artificial Sequence
  targeting sequence with TTCN PAM
uucuccuggucccccacaug

SEQ ID NO: 23140 - RNA, 20 nt, Artificial Sequence
  targeting sequence with TTCN PAM
uuggcuuucuuucuccuggu

SEQ ID NO: 23141 - RNA, 20 nt, Artificial Sequence
  targeting sequence with TTCN PAM
ccuccuccuccuccucuucc

SEQ ID NO: 23142 - RNA, 20 nt, Artificial Sequence
  targeting sequence with TTCN PAM
ccuccuucuccuccuccucc

SEQ ID NO: 23143 - RNA, 20 nt, Artificial Sequence
  targeting sequence with TTCN PAM
gccucugcaagagaggagcu

SEQ ID NO: 23144 - RNA, 20 nt, Artificial Sequence
  targeting sequence with TTCN PAM
aagccaagauggcuggaugc

SEQ ID NO: 23145 - RNA, 20 nt, Artificial Sequence
  targeting sequence with TTCN PAM
cuggacugcccgacacaagg

SEQ ID NO: 23146 - RNA, 20 nt, Artificial Sequence
  targeting sequence with TTCN PAM
aaucccagcucugcagagga

SEQ ID NO: 23147 - RNA, 20 nt, Artificial Sequence
  targeting sequence with TTCN PAM
ucugcagagcugggauuuga

SEQ ID NO: 23148 - RNA, 20 nt, Artificial Sequence
  targeting sequence with TTCN PAM
ucaguggucaguggggaguu

SEQ ID NO: 23149 - RNA, 20 nt, Artificial Sequence
  targeting sequence with TTCN PAM
uagggggcaggaggaguugu

SEQ ID NO: 23150 - RNA, 20 nt, Artificial Sequence
  targeting sequence with TTCN PAM
uucauucaacaaauguuuau

SEQ ID NO: 23151 - RNA, 20 nt, Artificial Sequence
  targeting sequence with TTCN PAM
uucaacaaauguuuauugaa

SEQ ID NO: 23152 - RNA, 20 nt, Artificial Sequence
  targeting sequence with TTCN PAM
acaaauguuuauugaacacc

SEQ ID NO: 23153 - RNA, 20 nt, Artificial Sequence
  targeting sequence with TTCN PAM
auaaacauuuguugaaugaa

SEQ ID NO: 23154 - RNA, 20 nt, Artificial Sequence
  targeting sequence with TTCN PAM
ucgcugccucugagcucaca

SEQ ID NO: 23155 - RNA, 20 nt, Artificial Sequence
  targeting sequence with TTCN PAM
agaaauagaugggaagucag

SEQ ID NO: 23156 - RNA, 20 nt, Artificial Sequence
  targeting sequence with TTCN PAM
agaaugcaggaccagccugg

SEQ ID NO: 23157 - RNA, 20 nt, Artificial Sequence
  targeting sequence with TTCN PAM
caucuauuucuagaaugcag

SEQ ID NO: 23158 - RNA, 20 nt, Artificial Sequence
  targeting sequence with TTCN PAM
uguccuaggcucaagugauc

SEQ ID NO: 23159 - RNA, 20 nt, Artificial Sequence
  targeting sequence with TTCN PAM
aggcugcaguaagcuaugau

SEQ ID NO: 23160 - RNA, 20 nt, Artificial Sequence
  targeting sequence with TTCN PAM
uaaaacaauuuuuaaauguu

SEQ ID NO: 23161 - RNA, 20 nt, Artificial Sequence
  targeting sequence with TTCN PAM
guuuuuacacagucauuacc

SEQ ID NO: 23162 - RNA, 20 nt, Artificial Sequence
  targeting sequence with TTCN PAM
cuaacucccaggcucaagug

SEQ ID NO: 23163 - RNA, 20 nt, Artificial Sequence
  targeting sequence with TTCN PAM
uuuuuguagaguugggcucu

SEQ ID NO: 23164 - RNA, 20 nt, Artificial Sequence
  targeting sequence with TTCN PAM
ccugccuuagccucccaagu

SEQ ID NO: 23165 - RNA, 20 nt, Artificial Sequence
  targeting sequence with TTCN PAM
agcgauucuccugccuuagc

SEQ ID NO: 23166 - RNA, 20 nt, Artificial Sequence
  targeting sequence with TTCN PAM
uggguucaagcgauucuccu

SEQ ID NO: 23167 - RNA, 20 nt, Artificial Sequence
  targeting sequence with TTCN PAM
ggucuccgcucacacucaug

SEQ ID NO: 23168 - RNA, 20 nt, Artificial Sequence
  targeting sequence with TTCN PAM
ugagucuccuucaggucucc

SEQ ID NO: 23169 - RNA, 20 nt, Artificial Sequence
  targeting sequence with TTCN PAM
cauuuuacagaguggagaac

SEQ ID NO: 23170 - RNA, 20 nt, Artificial Sequence
  targeting sequence with TTCN PAM
ccacucuguaaaaugggaau

SEQ ID NO: 23171 - RNA, 20 nt, Artificial Sequence
  targeting sequence with TTCN PAM
guucuccacucuguaaaaug

SEQ ID NO: 23172 - RNA, 20 nt, Artificial Sequence
  targeting sequence with TTCN PAM
acccacccuuacaucuggac

SEQ ID NO: 23173 - RNA, 20 nt, Artificial Sequence
  targeting sequence with TTCN PAM
cccucauugggcaaggcucu

SEQ ID NO: 23174 - RNA, 20 nt, Artificial Sequence
  targeting sequence with TTCN PAM
cuguucucccucauugggca

SEQ ID NO: 23175 - RNA, 20 nt, Artificial Sequence
  targeting sequence with TTCN PAM
cgaaccaggcucucauggag

SEQ ID NO: 23176 - RNA, 20 nt, Artificial Sequence
  targeting sequence with TTCN PAM
ugaaucuuuagacccuaugg

SEQ ID NO: 23177 - RNA, 20 nt, Artificial Sequence
  targeting sequence with TTCN PAM
ccaugagagccugguucgug

SEQ ID NO: 23178 - RNA, 20 nt, Artificial Sequence
  targeting sequence with TTCN PAM
ucgucugagcaaacugaggc

SEQ ID NO: 23179 - RNA, 20 nt, Artificial Sequence
  targeting sequence with TTCN PAM
ccucucugggccucaguuug

SEQ ID NO: 23180 - RNA, 20 nt, Artificial Sequence
  targeting sequence with TTCN PAM
uuccccucucugggccucag

SEQ ID NO: 23181 - RNA, 20 nt, Artificial Sequence
  targeting sequence with TTCN PAM
agcuggucuuugagucacca

SEQ ID NO: 23182 - RNA, 20 nt, Artificial Sequence
  targeting sequence with TTCN PAM
acugccccacgccaggccug

SEQ ID NO: 23183 - RNA, 20 nt, Artificial Sequence
  targeting sequence with TTCN PAM
auuaccccagcuaaaccuuu

SEQ ID NO: 23184 - RNA, 20 nt, Artificial Sequence
  targeting sequence with TTCN PAM
uuagucauuuauaccauggu

SEQ ID NO: 23185 - RNA, 20 nt, Artificial Sequence
  targeting sequence with TTCN PAM
caccaugguauaaaugacua

SEQ ID NO: 23186 - RNA, 20 nt, Artificial Sequence
  targeting sequence with TTCN PAM
ugagagcuaucuuugaugag

SEQ ID NO: 23187 - RNA, 20 nt, Artificial Sequence
  targeting sequence with TTCN PAM
caaaccuggcuaugccuccc

SEQ ID NO: 23188 - RNA, 20 nt, Artificial Sequence
  targeting sequence with TTCN PAM
ugggguaucagcuucccaaa

SEQ ID NO: 23189 - RNA, 20 nt, Artificial Sequence
  targeting sequence with TTCN PAM
ucugcaaaauggauauagca

SEQ ID NO: 23190 - RNA, 20 nt, Artificial Sequence
  targeting sequence with TTCN PAM
aaugacccuuccagcucacu

SEQ ID NO: 23191 - RNA, 20 nt, Artificial Sequence
  targeting sequence with TTCN PAM
aagucaccuacucugaccau

SEQ ID NO: 23192 - RNA, 20 nt, Artificial Sequence
  targeting sequence with TTCN PAM
agcucacuaugagucuguuu

SEQ ID NO: 23193 - RNA, 20 nt, Artificial Sequence
  targeting sequence with TTCN PAM
ugaacaaagagcauuuuuug

SEQ ID NO: 23194 - RNA, 20 nt, Artificial Sequence
  targeting sequence with TTCN PAM
ggaaaacagacucauaguga

SEQ ID NO: 23195 - RNA, 20 nt, Artificial Sequence
  targeting sequence with TTCN PAM
ugggccggacacggugguuc

SEQ ID NO: 23196 - RNA, 20 nt, Artificial Sequence
  targeting sequence with TTCN PAM
cuccuauaauccuggcacuu

SEQ ID NO: 23197 - RNA, 20 nt, Artificial Sequence
  targeting sequence with TTCN PAM
ggaccagccugggcaacaua

SEQ ID NO: 23198 - RNA, 20 nt, Artificial Sequence
  targeting sequence with TTCN PAM
ucgucaagcuuuacagaaua

SEQ ID NO: 23199 - RNA, 20 nt, Artificial Sequence
  targeting sequence with TTCN PAM
ucaagcuuuacagaauaaag

SEQ ID NO: 23200 - RNA, 20 nt, Artificial Sequence
  targeting sequence with TTCN PAM
guaaagcuugacgaagaaaa

SEQ ID NO: 23201 - RNA, 20 nt, Artificial Sequence
  targeting sequence with TTCN PAM
ccaucaccagggcuccauga

SEQ ID NO: 23202 - RNA, 20 nt, Artificial Sequence
  targeting sequence with TTCN PAM
caauugcaaccucauggagc

SEQ ID NO: 23203 - RNA, 20 nt, Artificial Sequence
  targeting sequence with TTCN PAM
uccuuugugaguuucacaau

SEQ ID NO: 23204 - RNA, 20 nt, Artificial Sequence
  targeting sequence with TTCN PAM
ccucucugucucagguuccu

SEQ ID NO: 23205 - RNA, 20 nt, Artificial Sequence
  targeting sequence with TTCN PAM
cccacucacucguucauuca

SEQ ID NO: 23206 - RNA, 20 nt, Artificial Sequence
  targeting sequence with TTCN PAM
uucaacaaauauucaggagc

SEQ ID NO: 23207 - RNA, 20 nt, Artificial Sequence
  targeting sequence with TTCN PAM
acaaauauucaggagcaccu

SEQ ID NO: 23208 - RNA, 20 nt, Artificial Sequence
  targeting sequence with TTCN PAM
ggagcaccuucuaggugcca

SEQ ID NO: 23209 - RNA, 20 nt, Artificial Sequence
  targeting sequence with TTCN PAM
aggugccaggcccuggagac

SEQ ID NO: 23210 - RNA, 20 nt, Artificial Sequence
  targeting sequence with TTCN PAM
cugaugugucuccagggccu

SEQ ID NO: 23211 - RNA, 20 nt, Artificial Sequence
  targeting sequence with TTCN PAM
acuacaggccaagcaccaug

SEQ ID NO: 23212 - RNA, 20 nt, Artificial Sequence
  targeting sequence with TTCN PAM
cagagaccagcauggugcuu

SEQ ID NO: 23213 - RNA, 20 nt, Artificial Sequence
  targeting sequence with TTCN PAM
augcugucagaagcacuaug

SEQ ID NO: 23214 - RNA, 20 nt, Artificial Sequence
  targeting sequence with TTCN PAM
gacagcauggaagcuuuuua

SEQ ID NO: 23215 - RNA, 20 nt, Artificial Sequence
  targeting sequence with TTCN PAM
ggccaugaggguccacguca

SEQ ID NO: 23216 - RNA, 20 nt, Artificial Sequence
  targeting sequence with TTCN PAM
gacguggacccucauggcca

SEQ ID NO: 23217 - RNA, 20 nt, Artificial Sequence
  targeting sequence with TTCN PAM
cugcagcccaccugggcucc

SEQ ID NO: 23218 - RNA, 20 nt, Artificial Sequence
  targeting sequence with TTCN PAM
gagcagacagaucugggaau

SEQ ID NO: 23219 - RNA, 20 nt, Artificial Sequence
  targeting sequence with TTCN PAM
cagaucugucugcucagaag

SEQ ID NO: 23220 - RNA, 20 nt, Artificial Sequence
  targeting sequence with TTCN PAM
cacccaggauucccagaucu

SEQ ID NO: 23221 - RNA, 20 nt, Artificial Sequence
  targeting sequence with TTCN PAM
caggcaucagggcuuugcac

SEQ ID NO: 23222 - RNA, 20 nt, Artificial Sequence
  targeting sequence with TTCN PAM
gccuggauguccuuccccug

SEQ ID NO: 23223 - RNA, 20 nt, Artificial Sequence
  targeting sequence with TTCN PAM
ccugaagcuuccuccuguug

SEQ ID NO: 23224 - RNA, 20 nt, Artificial Sequence
  targeting sequence with TTCN PAM
ggggaaggacauccaggcgg

SEQ ID NO: 23225 - RNA, 20 nt, Artificial Sequence
  targeting sequence with TTCN PAM
uccuguuguuccguucucag

SEQ ID NO: 23226 - RNA, 20 nt, Artificial Sequence
  targeting sequence with TTCN PAM
guucucagcucaagcuccag

SEQ ID NO: 23227 - RNA, 20 nt, Artificial Sequence
  targeting sequence with TTCN PAM
cagcucaagcuccagcuucu

SEQ ID NO: 23228 - RNA, 20 nt, Artificial Sequence
  targeting sequence with TTCN PAM
cagagaagccuccuguguug

SEQ ID NO: 23229 - RNA, 20 nt, Artificial Sequence
  targeting sequence with TTCN PAM
cugagaagcuggagcuugag

SEQ ID NO: 23230 - RNA, 20 nt, Artificial Sequence
  targeting sequence with TTCN PAM
gucgcagccacucccaacac

SEQ ID NO: 23231 - RNA, 20 nt, Artificial Sequence
  targeting sequence with TTCN PAM
cucuucuauuuguuuguggu

SEQ ID NO: 23232 - RNA, 20 nt, Artificial Sequence
  targeting sequence with TTCN PAM
auuuguuuguggucccugug

SEQ ID NO: 23233 - RNA, 20 nt, Artificial Sequence
  targeting sequence with TTCN PAM
ugugagcaggagcuugcucu

SEQ ID NO: 23234 - RNA, 20 nt, Artificial Sequence
  targeting sequence with TTCN PAM
uguacccuguguguccccaa

SEQ ID NO: 23235 - RNA, 20 nt, Artificial Sequence
  targeting sequence with TTCN PAM
uuccugggaggugucaucau

SEQ ID NO: 23236 - RNA, 20 nt, Artificial Sequence
  targeting sequence with TTCN PAM
ugggaggugucaucauguug

SEQ ID NO: 23237 - RNA, 20 nt, Artificial Sequence
  targeting sequence with TTCN PAM
cccagucaucugcccccaag

SEQ ID NO: 23238 - RNA, 20 nt, Artificial Sequence
  targeting sequence with TTCN PAM
uucucacgguacauccugcu

SEQ ID NO: 23239 - RNA, 20 nt, Artificial Sequence
  targeting sequence with TTCN PAM
cacgguacauccugcuauuc

SEQ ID NO: 23240 - RNA, 20 nt, Artificial Sequence
  targeting sequence with TTCN PAM
ggaaucggcccucguggggc

SEQ ID NO: 23241 - RNA, 20 nt, Artificial Sequence
  targeting sequence with TTCN PAM
agaauagcaggauguaccgu

SEQ ID NO: 23242 - RNA, 20 nt, Artificial Sequence
  targeting sequence with TTCN PAM
gacuggaguccccugaaggg

SEQ ID NO: 23243 - RNA, 20 nt, Artificial Sequence
  targeting sequence with TTCN PAM
ggggacuccagucugaaggg

SEQ ID NO: 23244 - RNA, 20 nt, Artificial Sequence
  targeting sequence with TTCN PAM
gccccuccccugcucuggua

SEQ ID NO: 23245 - RNA, 20 nt, Artificial Sequence
  targeting sequence with TTCN PAM
acaccagugaucugcccaag

SEQ ID NO: 23246 - RNA, 20 nt, Artificial Sequence
  targeting sequence with TTCN PAM
ucuggauaaagccagguucc

SEQ ID NO: 23247 - RNA, 20 nt, Artificial Sequence
  targeting sequence with TTCN PAM
ccggccuagcguucaagacc

SEQ ID NO: 23248 - RNA, 20 nt, Artificial Sequence
  targeting sequence with TTCN PAM
agacccauuacaacugcccc

SEQ ID NO: 23249 - RNA, 20 nt, Artificial Sequence
  targeting sequence with TTCN PAM
ccaccuagccaccuggcaaa

SEQ ID NO: 23250 - RNA, 20 nt, Artificial Sequence
  targeting sequence with TTCN PAM
cucaaaggcccaaacauggc

SEQ ID NO: 23251 - RNA, 20 nt, Artificial Sequence
  targeting sequence with TTCN PAM
guccaggguggcugugaggu

SEQ ID NO: 23252 - RNA, 20 nt, Artificial Sequence
  targeting sequence with TTCN PAM
ucccacauuugaguccuccu

SEQ ID NO: 23253 - RNA, 20 nt, Artificial Sequence
  targeting sequence with TTCN PAM
cacauuugaguccuccucag

SEQ ID NO: 23254 - RNA, 20 nt, Artificial Sequence
  targeting sequence with TTCN PAM
uuccaucuuuguauucccag

SEQ ID NO: 23255 - RNA, 20 nt, Artificial Sequence
  targeting sequence with TTCN PAM
aucuuuguauucccaggggc

SEQ ID NO: 23256 - RNA, 20 nt, Artificial Sequence
  targeting sequence with TTCN PAM
caggggccugcaaauaaaug

SEQ ID NO: 23257 - RNA, 20 nt, Artificial Sequence
  targeting sequence with TTCN PAM
uuaaacauuuauuugcaggc

SEQ ID NO: 23258 - RNA, 20 nt, Artificial Sequence
  targeting sequence with TTCN PAM
uucauuaaacauuuauuugc

SEQ ID NO: 23259 - RNA, 20 nt, Artificial Sequence
  targeting sequence with TTCN PAM
cucucuuguucguucauuaa

SEQ ID NO: 23260 - RNA, 20 nt, Artificial Sequence
  targeting sequence with TTCN PAM
aauuccaugcaacaaggauu

SEQ ID NO: 23261 - RNA, 20 nt, Artificial Sequence
  targeting sequence with TTCN PAM
augcaacaaggauugggcuc

SEQ ID NO: 23262 - RNA, 20 nt, Artificial Sequence
  targeting sequence with TTCN PAM
ggugccagacacauagccua

SEQ ID NO: 23263 - RNA, 20 nt, Artificial Sequence
  targeting sequence with TTCN PAM
guuucuggugccagacacau

SEQ ID NO: 23264 - RNA, 20 nt, Artificial Sequence
  targeting sequence with TTCN PAM
cccacaaguuaccucuggag

SEQ ID NO: 23265 - RNA, 20 nt, Artificial Sequence
  targeting sequence with TTCN PAM
uucccccacaaguuaccucu

SEQ ID NO: 23266 - RNA, 20 nt, Artificial Sequence
  targeting sequence with TTCN PAM
cccagucucucaucucguca

SEQ ID NO: 23267 - RNA, 20 nt, Artificial Sequence
  targeting sequence with TTCN PAM
gguuuauucucccagucucu

SEQ ID NO: 23268 - RNA, 20 nt, Artificial Sequence
  targeting sequence with TTCN PAM
aacccaggccaccagacuga

SEQ ID NO: 23269 - RNA, 20 nt, Artificial Sequence
  targeting sequence with TTCN PAM
gcaugacuugucugucccaa

SEQ ID NO: 23270 - RNA, 20 nt, Artificial Sequence
  targeting sequence with TTCN PAM
ccucccuuuuccuggauccu

SEQ ID NO: 23271 - RNA, 20 nt, Artificial Sequence
  targeting sequence with TTCN PAM
uggauccugaguaccucucc

SEQ ID NO: 23272 - RNA, 20 nt, Artificial Sequence
  targeting sequence with TTCN PAM
uccuagugucaccuuggccc

SEQ ID NO: 23273 - RNA, 20 nt, Artificial Sequence
  targeting sequence with TTCN PAM
aagaggggccaaggugacac

SEQ ID NO: 23274 - RNA, 20 nt, Artificial Sequence
  targeting sequence with TTCN PAM
gcagcggggauuaauaugau

SEQ ID NO: 23275 - RNA, 20 nt, Artificial Sequence
  targeting sequence with TTCN PAM
uaaucauauuaauccccgcu

SEQ ID NO: 23276 - RNA, 20 nt, Artificial Sequence
  targeting sequence with TTCN PAM
gccaggagcuuaggaggggg

SEQ ID NO: 23277 - RNA, 20 nt, Artificial Sequence
  targeting sequence with TTCN PAM
gacccccccagacccuuaua

SEQ ID NO: 23278 - RNA, 20 nt, Artificial Sequence
  targeting sequence with TTCN PAM
cagcauucuugggugggagc

SEQ ID NO: 23279 - RNA, 20 nt, Artificial Sequence
  targeting sequence with TTCN PAM
ugggugggagcagccacggg

SEQ ID NO: 23280 - RNA, 20 nt, Artificial Sequence
  targeting sequence with TTCN PAM
uggcuguggcccuuguggcu

SEQ ID NO: 23281 - RNA, 20 nt, Artificial Sequence
  targeting sequence with TTCN PAM
gugccauucauggcuguggc

SEQ ID NO: 23282 - RNA, 20 nt, Artificial Sequence
  targeting sequence with TTCN PAM
acgugcccuucuccaaugcg

SEQ ID NO: 23283 - RNA, 20 nt, Artificial Sequence
  targeting sequence with TTCN PAM
ccaaugcgacggguguggua

SEQ ID NO: 23284 - RNA, 20 nt, Artificial Sequence
  targeting sequence with TTCN PAM
aguacccacaguacuaccug

SEQ ID NO: 23285 - RNA, 20 nt, Artificial Sequence
  targeting sequence with TTCN PAM
ccaugcuggccgccuacaug

SEQ ID NO: 23286 - RNA, 20 nt, Artificial Sequence
  targeting sequence with TTCN PAM
gcugaucgugcugggcuucc

SEQ ID NO: 23287 - RNA, 20 nt, Artificial Sequence
  targeting sequence with TTCN PAM
ccaucaacuuccucacgcuc

SEQ ID NO: 23288 - RNA, 20 nt, Artificial Sequence
  targeting sequence with TTCN PAM
ucacgcucuacgucaccguc

SEQ ID NO: 23289 - RNA, 20 nt, Artificial Sequence
  targeting sequence with TTCN PAM
ugugcuggacggugacguag

SEQ ID NO: 23290 - RNA, 20 nt, Artificial Sequence
  targeting sequence with TTCN PAM
ugguccuagguggcuucacc

SEQ ID NO: 23291 - RNA, 20 nt, Artificial Sequence
  targeting sequence with TTCN PAM
ccagcacccucuacaccucu

SEQ ID NO: 23292 - RNA, 20 nt, Artificial Sequence
  targeting sequence with TTCN PAM
ucuucgggcccacaggaugc

SEQ ID NO: 23293 - RNA, 20 nt, Artificial Sequence
  targeting sequence with TTCN PAM
ggcccacaggaugcaauuug

SEQ ID NO: 23294 - RNA, 20 nt, Artificial Sequence
  targeting sequence with TTCN PAM
uugccacccugggcgguaug

SEQ ID NO: 23295 - RNA, 20 nt, Artificial Sequence
  targeting sequence with TTCN PAM
cccuucuccuguccugucaa

SEQ ID NO: 23296 - RNA, 20 nt, Artificial Sequence
  targeting sequence with TTCN PAM
ccuguccugucaauguuauc

SEQ ID NO: 23297 - RNA, 20 nt, Artificial Sequence
  targeting sequence with TTCN PAM
gucaacaaacaccauucaug

SEQ ID NO: 23298 - RNA, 20 nt, Artificial Sequence
  targeting sequence with TTCN PAM
uggugauagccgggcugcug

SEQ ID NO: 23299 - RNA, 20 nt, Artificial Sequence
  targeting sequence with TTCN PAM
gugccagcccugcacaaaca

SEQ ID NO: 23300 - RNA, 20 nt, Artificial Sequence
  targeting sequence with TTCN PAM
cagcaagaaaacugagcuga

SEQ ID NO: 23301 - RNA, 20 nt, Artificial Sequence
  targeting sequence with TTCN PAM
ugcugugaaauuagacaagc

SEQ ID NO: 23302 - RNA, 20 nt, Artificial Sequence
  targeting sequence with TTCN PAM
uugagccucagcucaguuuu

SEQ ID NO: 23303 - RNA, 20 nt, Artificial Sequence
  targeting sequence with TTCN PAM
aacucaacucugcacccguc

SEQ ID NO: 23304 - RNA, 20 nt, Artificial Sequence
  targeting sequence with TTCN PAM
cuuggagcagcugugcugag

SEQ ID NO: 23305 - RNA, 20 nt, Artificial Sequence
  targeting sequence with TTCN PAM
cacccugagcuugggccccc

SEQ ID NO: 23306 - RNA, 20 nt, Artificial Sequence
  targeting sequence with TTCN PAM
auucuccagucauugggucu

SEQ ID NO: 23307 - RNA, 20 nt, Artificial Sequence
  targeting sequence with TTCN PAM
ccagucauugggucuucccu

SEQ ID NO: 23308 - RNA, 20 nt, Artificial Sequence
  targeting sequence with TTCN PAM
cugugcugggcaaugggcuc

SEQ ID NO: 23309 - RNA, 20 nt, Artificial Sequence
  targeting sequence with TTCN PAM
aagucuccugguguugagaa

SEQ ID NO: 23310 - RNA, 20 nt, Artificial Sequence
  targeting sequence with TTCN PAM
caacaccaggagacuuggaa

SEQ ID NO: 23311 - RNA, 20 nt, Artificial Sequence
  targeting sequence with TTCN PAM
gagcggcugcuugcgguucu

SEQ ID NO: 23312 - RNA, 20 nt, Artificial Sequence
  targeting sequence with TTCN PAM
uuuuugcuuuagaauaaugu

SEQ ID NO: 23313 - RNA, 20 nt, Artificial Sequence
  targeting sequence with TTCN PAM
aaagcaaaaaggaacugcuu

SEQ ID NO: 23314 - RNA, 20 nt, Artificial Sequence
  targeting sequence with TTCN PAM
uguuaaaugcaagacauuau

SEQ ID NO: 23315 - RNA, 20 nt, Artificial Sequence
  targeting sequence with TTCN PAM
ucucuguuaagugggaucug

SEQ ID NO: 23316 - RNA, 20 nt, Artificial Sequence
  targeting sequence with TTCN PAM
ccucucccugccucaguuuu

SEQ ID NO: 23317 - RNA, 20 nt, Artificial Sequence
  targeting sequence with TTCN PAM
uggaucacagccaggagacc

SEQ ID NO: 23318 - RNA, 20 nt, Artificial Sequence
  targeting sequence with TTCN PAM
agcgucuccuccugcaucuc

SEQ ID NO: 23319 - RNA, 20 nt, Artificial Sequence
  targeting sequence with TTCN PAM
cagggaaucucuggccauug

SEQ ID NO: 23320 - RNA, 20 nt, Artificial Sequence
  targeting sequence with TTCN PAM
cugagaaugggaccgaggca

SEQ ID NO: 23321 - RNA, 20 nt, Artificial Sequence
  targeting sequence with TTCN PAM
auaaucacagaucacucagu

SEQ ID NO: 23322 - RNA, 20 nt, Artificial Sequence
  targeting sequence with TTCN PAM
ggccagaaggugggugugcc

SEQ ID NO: 23323 - RNA, 20 nt, Artificial Sequence
  targeting sequence with TTCN PAM
ggccagaacugagugaucug

SEQ ID NO: 23324 - RNA, 20 nt, Artificial Sequence
  targeting sequence with TTCN PAM
cugcagggucagucccaguu

SEQ ID NO: 23325 - RNA, 20 nt, Artificial Sequence
  targeting sequence with TTCN PAM
cuguuaggaaugucccaguu

SEQ ID NO: 23326 - RNA, 20 nt, Artificial Sequence
  targeting sequence with TTCN PAM
uaacagugaaagggacaaua

SEQ ID NO: 23327 - RNA, 20 nt, Artificial Sequence
  targeting sequence with TTCN PAM
auagggagaguggccauaua

SEQ ID NO: 23328 - RNA, 20 nt, Artificial Sequence
  targeting sequence with TTCN PAM
ugggguggugagcaggacag

SEQ ID NO: 23329 - RNA, 20 nt, Artificial Sequence
  targeting sequence with TTCN PAM
gacaucuguccugcucacca

SEQ ID NO: 23330 - RNA, 20 nt, Artificial Sequence
  targeting sequence with TTCN PAM
aucauuuccuucuucuuccu

SEQ ID NO: 23331 - RNA, 20 nt, Artificial Sequence
  targeting sequence with TTCN PAM
uucuucuuccucugggcaaa

SEQ ID NO: 23332 - RNA, 20 nt, Artificial Sequence
  targeting sequence with TTCN PAM
ucuuccucugggcaaaacau

SEQ ID NO: 23333 - RNA, 20 nt, Artificial Sequence
  targeting sequence with TTCN PAM
uccucugggcaaaacauugc

SEQ ID NO: 23334 - RNA, 20 nt, Artificial Sequence
  targeting sequence with TTCN PAM
ucugggcaaaacauugcaca

SEQ ID NO: 23335 - RNA, 20 nt, Artificial Sequence
  targeting sequence with TTCN PAM
uggcuccuaggagaggcccc

SEQ ID NO: 23336 - RNA, 20 nt, Artificial Sequence
  targeting sequence with TTCN PAM
uuucccgagaagggagaggg

SEQ ID NO: 23337 - RNA, 20 nt, Artificial Sequence
  targeting sequence with TTCN PAM
cgagaagggagagggaggaa

SEQ ID NO: 23338 - RNA, 20 nt, Artificial Sequence
  targeting sequence with TTCN PAM
cgggaaaugaaauaacccgg

SEQ ID NO: 23339 - RNA, 20 nt, Artificial Sequence
  targeting sequence with TTCN PAM
ucccucucccuucucgggaa

SEQ ID NO: 23340 - RNA, 20 nt, Artificial Sequence
  targeting sequence with TTCN PAM
ggguuuccaccaccucugca

SEQ ID NO: 23341 - RNA, 20 nt, Artificial Sequence
  targeting sequence with TTCN PAM
accaccucugcauuccuucc

SEQ ID NO: 23342 - RNA, 20 nt, Artificial Sequence
  targeting sequence with TTCN PAM
uucccaacaaggaacucugc

SEQ ID NO: 23343 - RNA, 20 nt, Artificial Sequence
  targeting sequence with TTCN PAM
caacaaggaacucugcccca

SEQ ID NO: 23344 - RNA, 20 nt, Artificial Sequence
  targeting sequence with TTCN PAM
uuguugggaaggaaugcaga

SEQ ID NO: 23345 - RNA, 20 nt, Artificial Sequence
  targeting sequence with TTCN PAM
ucugcuaaacacacacacac

SEQ ID NO: 23346 - RNA, 20 nt, Artificial Sequence
  targeting sequence with TTCN PAM
gcuaaacacacacacacaca

SEQ ID NO: 23347 - RNA, 20 nt, Artificial Sequence
  targeting sequence with TTCN PAM
caguucaauccugacccccu

SEQ ID NO: 23348 - RNA, 20 nt, Artificial Sequence
  targeting sequence with TTCN PAM
auccugacccccugaucuga

SEQ ID NO: 23349 - RNA, 20 nt, Artificial Sequence
  targeting sequence with TTCN PAM
ugucccuuaugggcccagag

SEQ ID NO: 23350 - RNA, 20 nt, Artificial Sequence
  targeting sequence with TTCN PAM
cccauucccuggaauuucuu

SEQ ID NO: 23351 - RNA, 20 nt, Artificial Sequence
  targeting sequence with TTCN PAM
cuggaauuucuuugcccagc

SEQ ID NO: 23352 - RNA, 20 nt, Artificial Sequence
  targeting sequence with TTCN PAM
agggaaugggggaaguuauu

SEQ ID NO: 23353 - RNA, 20 nt, Artificial Sequence
  targeting sequence with TTCN PAM
uugcccagcucuccucagcg

SEQ ID NO: 23354 - RNA, 20 nt, Artificial Sequence
  targeting sequence with TTCN PAM
cccuccucccagcaccaagc

SEQ ID NO: 23355 - RNA, 20 nt, Artificial Sequence
  targeting sequence with TTCN PAM
ccaaggccuccucaaauccc

SEQ ID NO: 23356 - RNA, 20 nt, Artificial Sequence
  targeting sequence with TTCN PAM
uagcuacccucucccugucu

SEQ ID NO: 23357 - RNA, 20 nt, Artificial Sequence
  targeting sequence with TTCN PAM
ccugcaaggcagucagcagg

SEQ ID NO: 23358 - RNA, 20 nt, Artificial Sequence
  targeting sequence with TTCN PAM
gcuucggggagaaccaugcc

SEQ ID NO: 23359 - RNA, 20 nt, Artificial Sequence
  targeting sequence with TTCN PAM
gggagaaccaugccaucaug

SEQ ID NO: 23360 - RNA, 20 nt, Artificial Sequence
  targeting sequence with TTCN PAM
ccccgaagcggaaguugcuc

SEQ ID NO: 23361 - RNA, 20 nt, Artificial Sequence
  targeting sequence with TTCN PAM
ccugggucauggcgcuggcc

SEQ ID NO: 23362 - RNA, 20 nt, Artificial Sequence
  targeting sequence with TTCN PAM
gcucagugccauuaccugga

SEQ ID NO: 23363 - RNA, 20 nt, Artificial Sequence
  targeting sequence with TTCN PAM
cuucugcucagugccauuac

SEQ ID NO: 23364 - RNA, 20 nt, Artificial Sequence
  targeting sequence with TTCN PAM
ucccuucugcucagugccau

SEQ ID NO: 23365 - RNA, 20 nt, Artificial Sequence
  targeting sequence with TTCN PAM
aggcacugaccuuguauguc

SEQ ID NO: 23366 - RNA, 20 nt, Artificial Sequence
  targeting sequence with TTCN PAM
gcccuacaccccuacccuga

SEQ ID NO: 23367 - RNA, 20 nt, Artificial Sequence
  targeting sequence with TTCN PAM
ucugcccuacaccccuaccc

SEQ ID NO: 23368 - RNA, 20 nt, Artificial Sequence
  targeting sequence with TTCN PAM
ucuucugcccuacaccccua

SEQ ID NO: 23369 - RNA, 20 nt, Artificial Sequence
  targeting sequence with TTCN PAM
guuugacauggggcucagga

SEQ ID NO: 23370 - RNA, 20 nt, Artificial Sequence
  targeting sequence with TTCN PAM
ccuuggcugugccccuaauc

SEQ ID NO: 23371 - RNA, 20 nt, Artificial Sequence
  targeting sequence with TTCN PAM
aauccucuuuggucuaguac

SEQ ID NO: 23372 - RNA, 20 nt, Artificial Sequence
  targeting sequence with TTCN PAM
uagugcagguggccauauug

SEQ ID NO: 23373 - RNA, 20 nt, Artificial Sequence
  targeting sequence with TTCN PAM
aaggggccacaauauggcca

SEQ ID NO: 23374 - RNA, 20 nt, Artificial Sequence
  targeting sequence with TTCN PAM
ggagacagagggacaugagg

SEQ ID NO: 23375 - RNA, 20 nt, Artificial Sequence
  targeting sequence with TTCN PAM
cacucucacuucccuuuccu

SEQ ID NO: 23376 - RNA, 20 nt, Artificial Sequence
  targeting sequence with TTCN PAM
cuuuccuccucagucuugcu

SEQ ID NO: 23377 - RNA, 20 nt, Artificial Sequence
  targeting sequence with TTCN PAM
uccucagucuugcuaggguc

SEQ ID NO: 23378 - RNA, 20 nt, Artificial Sequence
  targeting sequence with TTCN PAM
uaccccuugcugaauuugag

SEQ ID NO: 23379 - RNA, 20 nt, Artificial Sequence
  targeting sequence with TTCN PAM
gcaagggguaagaaauggac

SEQ ID NO: 23380 - RNA, 20 nt, Artificial Sequence
  targeting sequence with TTCN PAM
ccaucuucuccaaucuggcc

SEQ ID NO: 23381 - RNA, 20 nt, Artificial Sequence
  targeting sequence with TTCN PAM
ccaaucuggccuaguucuau

SEQ ID NO: 23382 - RNA, 20 nt, Artificial Sequence
  targeting sequence with TTCN PAM
auccucuggaagcagagccg

SEQ ID NO: 23383 - RNA, 20 nt, Artificial Sequence
  targeting sequence with TTCN PAM
agaggauagaacuaggccag

SEQ ID NO: 23384 - RNA, 20 nt, Artificial Sequence
  targeting sequence with TTCN PAM
ugaggcccguccacugucac

SEQ ID NO: 23385 - RNA, 20 nt, Artificial Sequence
  targeting sequence with TTCN PAM
ugauauuggugacaguggac

SEQ ID NO: 23386 - RNA, 20 nt, Artificial Sequence
  targeting sequence with TTCN PAM
agcgcacgucauuaggacgu

SEQ ID NO: 23387 - RNA, 20 nt, Artificial Sequence
  targeting sequence with TTCN PAM
agaagcugcacaaagauccc

SEQ ID NO: 23388 - RNA, 20 nt, Artificial Sequence
  targeting sequence with TTCN PAM
ggaaacuagaggcuuccagc

SEQ ID NO: 23389 - RNA, 20 nt, Artificial Sequence
  targeting sequence with TTCN PAM
aggccaaagauggacacaca

SEQ ID NO: 23390 - RNA, 20 nt, Artificial Sequence
  targeting sequence with TTCN PAM
uagccccagggugagaguau

SEQ ID NO: 23391 - RNA, 20 nt, Artificial Sequence
  targeting sequence with TTCN PAM
ucaaaugcagagccugaggg

SEQ ID NO: 23392 - RNA, 20 nt, Artificial Sequence
  targeting sequence with TTCN PAM
uuguuugguggcugcguuac

SEQ ID NO: 23393 - RNA, 20 nt, Artificial Sequence
  targeting sequence with TTCN PAM
acaaggugcaucugcauccc

SEQ ID NO: 23394 - RNA, 20 nt, Artificial Sequence
  targeting sequence with TTCN PAM
auccugucacccagccaugc

SEQ ID NO: 23395 - RNA, 20 nt, Artificial Sequence
  targeting sequence with TTCN PAM
agggagggaaugugaagccc

SEQ ID NO: 23396 - RNA, 20 nt, Artificial Sequence
  targeting sequence with TTCN PAM
cucccuggaaaaggggauca

SEQ ID NO: 23397 - RNA, 20 nt, Artificial Sequence
  targeting sequence with TTCN PAM
cauucccucccuggaaaagg

SEQ ID NO: 23398 - RNA, 20 nt, Artificial Sequence
  targeting sequence with TTCN PAM
ggggcuucacauucccuccc

SEQ ID NO: 23399 - RNA, 20 nt, Artificial Sequence
  targeting sequence with TTCN PAM
caagucccucacaggcaggg

SEQ ID NO: 23400 - RNA, 20 nt, Artificial Sequence
  targeting sequence with TTCN PAM
acacgagcacugcaggcccu

SEQ ID NO: 23401 - RNA, 20 nt, Artificial Sequence
  targeting sequence with TTCN PAM
ugguccacuucaccaucccc

SEQ ID NO: 23402 - RNA, 20 nt, Artificial Sequence
  targeting sequence with TTCN PAM
ccauccccaugauuaucauc

SEQ ID NO: 23403 - RNA, 20 nt, Artificial Sequence
  targeting sequence with TTCN PAM
gcuaugggcagcucgucuuc

SEQ ID NO: 23404 - RNA, 20 nt, Artificial Sequence
  targeting sequence with TTCN PAM
ccgucaaggagguacgggcc

SEQ ID NO: 23405 - RNA, 20 nt, Artificial Sequence
  targeting sequence with TTCN PAM
gugugguggcugacuccugc

SEQ ID NO: 23406 - RNA, 20 nt, Artificial Sequence
  targeting sequence with TTCN PAM
cugccuucugugugguggcu

SEQ ID NO: 23407 - RNA, 20 nt, Artificial Sequence
  targeting sequence with TTCN PAM
ugaucugcugggugcccuac

SEQ ID NO: 23408 - RNA, 20 nt, Artificial Sequence
  targeting sequence with TTCN PAM
acaucuucacccaccagggc

SEQ ID NO: 23409 - RNA, 20 nt, Artificial Sequence
  targeting sequence with TTCN PAM
cccaccagggcuccaacuuc

SEQ ID NO: 23410 - RNA, 20 nt, Artificial Sequence
  targeting sequence with TTCN PAM
gucccaucuucaugaccauc

SEQ ID NO: 23411 - RNA, 20 nt, Artificial Sequence
  targeting sequence with TTCN PAM
ugaccaucccagcguucuuu

SEQ ID NO: 23412 - RNA, 20 nt, Artificial Sequence
  targeting sequence with TTCN PAM
uugccaagagcgccgccauc

SEQ ID NO: 23413 - RNA, 20 nt, Artificial Sequence
  targeting sequence with TTCN PAM
ucaugauauagaugacaggg

SEQ ID NO: 23414 - RNA, 20 nt, Artificial Sequence
  targeting sequence with TTCN PAM
cagggcaggggagggggcuc

SEQ ID NO: 23415 - RNA, 20 nt, Artificial Sequence
  targeting sequence with TTCN PAM
cacacacuccccauugggac

SEQ ID NO: 23416 - RNA, 20 nt, Artificial Sequence
  targeting sequence with TTCN PAM
uggccccacucagaacugcu

SEQ ID NO: 23417 - RNA, 20 nt, Artificial Sequence
  targeting sequence with TTCN PAM
gaguggggccaggaaucugc

SEQ ID NO: 23418 - RNA, 20 nt, Artificial Sequence
  targeting sequence with TTCN PAM
gcaguucugaguggggccag

SEQ ID NO: 23419 - RNA, 20 nt, Artificial Sequence
  targeting sequence with TTCN PAM
ugggcccacccugagauuca

SEQ ID NO: 23420 - RNA, 20 nt, Artificial Sequence
  targeting sequence with TTCN PAM
agcaagcccuccacaggugg

SEQ ID NO: 23421 - RNA, 20 nt, Artificial Sequence
  targeting sequence with TTCN PAM
cccaccugagugagcaucug

SEQ ID NO: 23422 - RNA, 20 nt, Artificial Sequence
  targeting sequence with TTCN PAM
ggaagcccaaugucaaaguc

SEQ ID NO: 23423 - RNA, 20 nt, Artificial Sequence
  targeting sequence with TTCN PAM
agaacuagcugacuggagcu

SEQ ID NO: 23424 - RNA, 20 nt, Artificial Sequence
  targeting sequence with TTCN PAM
gacuuugacauugggcuucc

SEQ ID NO: 23425 - RNA, 20 nt, Artificial Sequence
  targeting sequence with TTCN PAM
cgacuuggguccuucugacu

SEQ ID NO: 23426 - RNA, 20 nt, Artificial Sequence
  targeting sequence with TTCN PAM
gcuuuauggagacuggccca

SEQ ID NO: 23427 - RNA, 20 nt, Artificial Sequence
  targeting sequence with TTCN PAM
gagggguaaagggguaaagg

SEQ ID NO: 23428 - RNA, 20 nt, Artificial Sequence
  targeting sequence with TTCN PAM
ucggagagguaccuccgagg

SEQ ID NO: 23429 - RNA, 20 nt, Artificial Sequence
  targeting sequence with TTCN PAM
gagacuguuuacccaacugu

SEQ ID NO: 23430 - RNA, 20 nt, Artificial Sequence
  targeting sequence with TTCN PAM
agcuguauggcccugggcaa

SEQ ID NO: 23431 - RNA, 20 nt, Artificial Sequence
  targeting sequence with TTCN PAM
uucucugugcuuugguuucc

SEQ ID NO: 23432 - RNA, 20 nt, Artificial Sequence
  targeting sequence with TTCN PAM
cugugcuuugguuuccucau

SEQ ID NO: 23433 - RNA, 20 nt, Artificial Sequence
  targeting sequence with TTCN PAM
ucauccauagaaagguagaa

SEQ ID NO: 23434 - RNA, 20 nt, Artificial Sequence
  targeting sequence with TTCN PAM
auggaugaggaaaccaaagc

SEQ ID NO: 23435 - RNA, 20 nt, Artificial Sequence
  targeting sequence with TTCN PAM
accuuucuauggaugaggaa

SEQ ID NO: 23436 - RNA, 20 nt, Artificial Sequence
  targeting sequence with TTCN PAM
guaaauuaucucuuguaauc

SEQ ID NO: 23437 - RNA, 20 nt, Artificial Sequence
  targeting sequence with TTCN PAM
uggugcccucugugugccaa

SEQ ID NO: 23438 - RNA, 20 nt, Artificial Sequence
  targeting sequence with TTCN PAM
cuccaggaagcuggauuuga

SEQ ID NO: 23439 - RNA, 20 nt, Artificial Sequence
  targeting sequence with TTCN PAM
uggagggaaccugcuaggca

SEQ ID NO: 23440 - RNA, 20 nt, Artificial Sequence
  targeting sequence with TTCN PAM
agcgccccauccacucaaau

SEQ ID NO: 23441 - RNA, 20 nt, Artificial Sequence
  targeting sequence with TTCN PAM
gccccucacgauuccagcgc

SEQ ID NO: 23442 - RNA, 20 nt, Artificial Sequence
  targeting sequence with TTCN PAM
ccccgacccuuugccugcuu

SEQ ID NO: 23443 - RNA, 20 nt, Artificial Sequence
  targeting sequence with TTCN PAM
aagcacacugugggcagccc

SEQ ID NO: 23444 - RNA, 20 nt, Artificial Sequence
  targeting sequence with TTCN PAM
aguuccggaacugcaugcuc

SEQ ID NO: 23445 - RNA, 20 nt, Artificial Sequence
  targeting sequence with TTCN PAM
ggaacugcaugcucaccacc

SEQ ID NO: 23446 - RNA, 20 nt, Artificial Sequence
  targeting sequence with TTCN PAM
ggaacuggaaggcaagaggc

SEQ ID NO: 23447 - RNA, 20 nt, Artificial Sequence
  targeting sequence with TTCN PAM
ugccgcagcagaugguggug

SEQ ID NO: 23448 - RNA, 20 nt, Artificial Sequence
  targeting sequence with TTCN PAM
cccagccacagccaucccac

SEQ ID NO: 23449 - RNA, 20 nt, Artificial Sequence
  targeting sequence with TTCN PAM
gcacaggcgcugcuccuggu

SEQ ID NO: 23450 - RNA, 20 nt, Artificial Sequence
  targeting sequence with TTCN PAM
uucugcacaggcgcugcucc

SEQ ID NO: 23451 - RNA, 20 nt, Artificial Sequence
  targeting sequence with TTCN PAM
uucauucugcacaggcgcug

SEQ ID NO: 23452 - RNA, 20 nt, Artificial Sequence
  targeting sequence with TTCN PAM
uaaaaaaaaaaaaaaaauua

SEQ ID NO: 23453 - RNA, 20 nt, Artificial Sequence
  targeting sequence with TTCN PAM
caggcugucccaggugagug

SEQ ID NO: 23454 - RNA, 20 nt, Artificial Sequence
  targeting sequence with TTCN PAM
ccaaggccagcgggaugugu

SEQ ID NO: 23455 - RNA, 20 nt, Artificial Sequence
  targeting sequence with TTCN PAM
ggaacacgaggauucuugcu

SEQ ID NO: 23456 - RNA, 20 nt, Artificial Sequence
  targeting sequence with TTCN PAM
ugaaagaugaguugggagga

SEQ ID NO: 23457 - RNA, 20 nt, Artificial Sequence
  targeting sequence with TTCN PAM
ugcuuucuggaaaagugucc

SEQ ID NO: 23458 - RNA, 20 nt, Artificial Sequence
  targeting sequence with TTCN PAM
ggaaaagugucccagcuuag

SEQ ID NO: 23459 - RNA, 20 nt, Artificial Sequence
  targeting sequence with TTCN PAM
agaaagcaagaauccucgug

SEQ ID NO: 23460 - RNA, 20 nt, Artificial Sequence
  targeting sequence with TTCN PAM
gugcuagacacuuaucccua

SEQ ID NO: 23461 - RNA, 20 nt, Artificial Sequence
  targeting sequence with TTCN PAM
ugcauccauccagcauuuau

SEQ ID NO: 23462 - RNA, 20 nt, Artificial Sequence
  targeting sequence with TTCN PAM
uuccugcauccauccagcau

SEQ ID NO: 23463 - RNA, 20 nt, Artificial Sequence
  targeting sequence with TTCN PAM
uccauuccuuccugcaucca

SEQ ID NO: 23464 - RNA, 20 nt, Artificial Sequence
  targeting sequence with TTCN PAM
uuccuccauuccuuccugca

SEQ ID NO: 23465 - RNA, 20 nt, Artificial Sequence
  targeting sequence with TTCN PAM
cauucauuccuccauuccuu

SEQ ID NO: 23466 - RNA, 20 nt, Artificial Sequence
  targeting sequence with TTCN PAM
cccuucccauucauuccucc

SEQ ID NO: 23467 - RNA, 20 nt, Artificial Sequence
  targeting sequence with TTCN PAM
cucccugggccucacuuucu

SEQ ID NO: 23468 - RNA, 20 nt, Artificial Sequence
  targeting sequence with TTCN PAM
ucuccuauaaaauggaaauc

SEQ ID NO: 23469 - RNA, 20 nt, Artificial Sequence
  targeting sequence with TTCN PAM
ccuauaaaauggaaauccca

SEQ ID NO: 23470 - RNA, 20 nt, Artificial Sequence
  targeting sequence with TTCN PAM
auuuuauaggagaagaaagu

SEQ ID NO: 23471 - RNA, 20 nt, Artificial Sequence
  targeting sequence with TTCN PAM
caguagcugcgugucggcag

SEQ ID NO: 23472 - RNA, 20 nt, Artificial Sequence
  targeting sequence with TTCN PAM
gcacuuuguaaauagcaaga

SEQ ID NO: 23473 - RNA, 20 nt, Artificial Sequence
  targeting sequence with TTCN PAM
ugcuauuuacaaagugcuga

SEQ ID NO: 23474 - RNA, 20 nt, Artificial Sequence
  targeting sequence with TTCN PAM
aguuaauguugugaauaaca

SEQ ID NO: 23475 - RNA, 20 nt, Artificial Sequence
  targeting sequence with TTCN PAM
caacauuaacuagaaucugu

SEQ ID NO: 23476 - RNA, 20 nt, Artificial Sequence
  targeting sequence with TTCN PAM
cuaucaggaggugauaauca

SEQ ID NO: 23477 - RNA, 20 nt, Artificial Sequence
  targeting sequence with TTCN PAM
gaugaugggguuucacccaa

SEQ ID NO: 23478 - RNA, 20 nt, Artificial Sequence
  targeting sequence with TTCN PAM
cccaaccuuggggcagguuu

SEQ ID NO: 23479 - RNA, 20 nt, Artificial Sequence
  targeting sequence with TTCN PAM
ugugacugucccugccuaca

SEQ ID NO: 23480 - RNA, 20 nt, Artificial Sequence
  targeting sequence with TTCN PAM
gcauuccugugacugucccu

SEQ ID NO: 23481 - RNA, 20 nt, Artificial Sequence
  targeting sequence with TTCN PAM
ggucugaugacugcauucug

SEQ ID NO: 23482 - RNA, 20 nt, Artificial Sequence
  targeting sequence with TTCN PAM
ccgucccccucccccagugu

SEQ ID NO: 23483 - RNA, 20 nt, Artificial Sequence
  targeting sequence with TTCN PAM
caaugagggugagauugggc

SEQ ID NO: 23484 - RNA, 20 nt, Artificial Sequence
  targeting sequence with TTCN PAM
caauguggccuauggagaga

SEQ ID NO: 23485 - RNA, 20 nt, Artificial Sequence
  targeting sequence with TTCN PAM
cucagccucuggaagccacc

SEQ ID NO: 23486 - RNA, 20 nt, Artificial Sequence
  targeting sequence with TTCN PAM
agaggcugagagaaaggccu

SEQ ID NO: 23487 - RNA, 20 nt, Artificial Sequence
  targeting sequence with TTCN PAM
agaggcuccaugcucuagau

SEQ ID NO: 23488 - RNA, 20 nt, Artificial Sequence
  targeting sequence with TTCN PAM
agauaaggaugacaucaggg

SEQ ID NO: 23489 - RNA, 20 nt, Artificial Sequence
  targeting sequence with TTCN PAM
aagcucuucgagauaaggau

SEQ ID NO: 23490 - RNA, 20 nt, Artificial Sequence
  targeting sequence with TTCN PAM
cacucuuuguuucuaagcuc

SEQ ID NO: 23491 - RNA, 20 nt, Artificial Sequence
  targeting sequence with TTCN PAM
acugggccuaccuuccuugg

SEQ ID NO: 23492 - RNA, 20 nt, Artificial Sequence
  targeting sequence with TTCN PAM
uuggggauguucaugggccc

SEQ ID NO: 23493 - RNA, 20 nt, Artificial Sequence
  targeting sequence with TTCN PAM
ugggccccaguuuccaguuu

SEQ ID NO: 23494 - RNA, 20 nt, Artificial Sequence
  targeting sequence with TTCN PAM
aguuucccuugccagacaag

SEQ ID NO: 23495 - RNA, 20 nt, Artificial Sequence
  targeting sequence with TTCN PAM
cuugccagacaagcccaucu

SEQ ID NO: 23496 - RNA, 20 nt, Artificial Sequence
  targeting sequence with TTCN PAM
gcaguugcuaguccauucuc

SEQ ID NO: 23497 - RNA, 20 nt, Artificial Sequence
  targeting sequence with TTCN PAM
ccauucuggagaaucugcuc

SEQ ID NO: 23498 - RNA, 20 nt, Artificial Sequence
  targeting sequence with TTCN PAM
ggagaaucugcuccaaaaag

SEQ ID NO: 23499 - RNA, 20 nt, Artificial Sequence
  targeting sequence with TTCN PAM
ccagaauggagaauggacua

SEQ ID NO: 23500 - RNA, 20 nt, Artificial Sequence
  targeting sequence with TTCN PAM
gacaccucagagauguggcc

SEQ ID NO: 23501 - RNA, 20 nt, Artificial Sequence
  targeting sequence with TTCN PAM
ccauauaagcaaagccagaa

SEQ ID NO: 23502 - RNA, 20 nt, Artificial Sequence
  targeting sequence with TTCN PAM
ggcuuugcuuauauggagaa

SEQ ID NO: 23503 - RNA, 20 nt, Artificial Sequence
  targeting sequence with TTCN PAM
cacucuauccacaggauaga

SEQ ID NO: 23504 - RNA, 20 nt, Artificial Sequence
  targeting sequence with TTCN PAM
aucuauccuguggauagagu

SEQ ID NO: 23505 - RNA, 20 nt, Artificial Sequence
  targeting sequence with TTCN PAM
accugaucccugacccuggg

SEQ ID NO: 23506 - RNA, 20 nt, Artificial Sequence
  targeting sequence with TTCN PAM
caggacugccuccuccaccu

SEQ ID NO: 23507 - RNA, 20 nt, Artificial Sequence
  targeting sequence with TTCN PAM
cauucccaggacugccuccu

SEQ ID NO: 23508 - RNA, 20 nt, Artificial Sequence
  targeting sequence with TTCN PAM
uuaucugcaaaaaagaaucu

SEQ ID NO: 23509 - RNA, 20 nt, Artificial Sequence
  targeting sequence with TTCN PAM
uuuuugcagauaaggaagcu

SEQ ID NO: 23510 - RNA, 20 nt, Artificial Sequence
  targeting sequence with TTCN PAM
ccguguuggucaggcugguc

SEQ ID NO: 23511 - RNA, 20 nt, Artificial Sequence
  targeting sequence with TTCN PAM
gugggcugaggcaggagaau

SEQ ID NO: 23512 - RNA, 20 nt, Artificial Sequence
  targeting sequence with TTCN PAM
ccugccucagcccacugaau

SEQ ID NO: 23513 - RNA, 20 nt, Artificial Sequence
  targeting sequence with TTCN PAM
agcgauucuccugccucagc

SEQ ID NO: 23514 - RNA, 20 nt, Artificial Sequence
  targeting sequence with TTCN PAM
gcucagagcuggccuuacua

SEQ ID NO: 23515 - RNA, 20 nt, Artificial Sequence
  targeting sequence with TTCN PAM
ccuuugggacagggucucua

SEQ ID NO: 23516 - RNA, 20 nt, Artificial Sequence
  targeting sequence with TTCN PAM
caccucggaggaggggguga

SEQ ID NO: 23517 - RNA, 20 nt, Artificial Sequence
  targeting sequence with TTCN PAM
uaucacuugugaccaaaagu

SEQ ID NO: 23518 - RNA, 20 nt, Artificial Sequence
  targeting sequence with TTCN PAM
gcccaaaugaguuggauuuc

SEQ ID NO: 23519 - RNA, 20 nt, Artificial Sequence
  targeting sequence with TTCN PAM
ugugagccaacaaugugucc

SEQ ID NO: 23520 - RNA, 20 nt, Artificial Sequence
  targeting sequence with TTCN PAM
ggcacaggguaucaccauga

SEQ ID NO: 23521 - RNA, 20 nt, Artificial Sequence
  targeting sequence with TTCN PAM
gugauuggccaagucuaggu

SEQ ID NO: 23522 - RNA, 20 nt, Artificial Sequence
  targeting sequence with TTCN PAM
aauaauggaauacuaggcau

SEQ ID NO: 23523 - RNA, 20 nt, Artificial Sequence
  targeting sequence with TTCN PAM
auuauuggaacgcuaagcau

SEQ ID NO: 23524 - RNA, 20 nt, Artificial Sequence
  targeting sequence with TTCN PAM
agccauggugaugcaguuag

SEQ ID NO: 23525 - RNA, 20 nt, Artificial Sequence
  targeting sequence with TTCN PAM
uccucugauuggucagaccu

SEQ ID NO: 23526 - RNA, 20 nt, Artificial Sequence
  targeting sequence with TTCN PAM
gccugcuugggcugcagggu

SEQ ID NO: 23527 - RNA, 20 nt, Artificial Sequence
  targeting sequence with TTCN PAM
caaaggaaagcccaggugcu

SEQ ID NO: 23528 - RNA, 20 nt, Artificial Sequence
  targeting sequence with TTCN PAM
uuugugaaaccuaccucucc

SEQ ID NO: 23529 - RNA, 20 nt, Artificial Sequence
  targeting sequence with TTCN PAM
gguaacagcaccugggcuuu

SEQ ID NO: 23530 - RNA, 20 nt, Artificial Sequence
  targeting sequence with TTCN PAM
cucuggguugauguuggcuc

SEQ ID NO: 23531 - RNA, 20 nt, Artificial Sequence
  targeting sequence with TTCN PAM
auucccucuggguugauguu

SEQ ID NO: 23532 - RNA, 20 nt, Artificial Sequence
  targeting sequence with TTCN PAM
gggcacguggcuggaccagg

SEQ ID NO: 23533 - RNA, 20 nt, Artificial Sequence
  targeting sequence with TTCN PAM
cccucaugucccugagauga

SEQ ID NO: 23534 - RNA, 20 nt, Artificial Sequence
  targeting sequence with TTCN PAM
uauggguggucccgaagguc

SEQ ID NO: 23535 - RNA, 20 nt, Artificial Sequence
  targeting sequence with TTCN PAM
ggaccacccauaggaaucuu

SEQ ID NO: 23536 - RNA, 20 nt, Artificial Sequence
  targeting sequence with TTCN PAM
agcuccccgccccaacccca

SEQ ID NO: 23537 - RNA, 20 nt, Artificial Sequence
  targeting sequence with TTCN PAM
gagaaaugguacauuugccc

SEQ ID NO: 23538 - RNA, 20 nt, Artificial Sequence
  targeting sequence with TTCN PAM
cagaaaaagugggcuggguu

SEQ ID NO: 23539 - RNA, 20 nt, Artificial Sequence
  targeting sequence with TTCN PAM
ucuggacaugaggcuggggc

SEQ ID NO: 23540 - RNA, 20 nt, Artificial Sequence
  targeting sequence with TTCN PAM
gguguuagaguaaaauuuuc

SEQ ID NO: 23541 - RNA, 20 nt, Artificial Sequence
  targeting sequence with TTCN PAM
cugguuuguccugauagaca

SEQ ID NO: 23542 - RNA, 20 nt, Artificial Sequence
  targeting sequence with TTCN PAM
ugucuaucaggacaaaccag

SEQ ID NO: 23543 - RNA, 20 nt, Artificial Sequence
  targeting sequence with TTCN PAM
ugggcacuugcauacauaaa

SEQ ID NO: 23544 - RNA, 20 nt, Artificial Sequence
  targeting sequence with TTCN PAM
cuuuauguaugcaagugccc

SEQ ID NO: 23545 - RNA, 20 nt, Artificial Sequence
  targeting sequence with TTCN PAM
accaaaccugagcaagcuga

SEQ ID NO: 23546 - RNA, 20 nt, Artificial Sequence
  targeting sequence with TTCN PAM
ggcauggggucagcuugcuc

SEQ ID NO: 23547 - RNA, 20 nt, Artificial Sequence
  targeting sequence with TTCN PAM
ucuccgaguccccagugcau

SEQ ID NO: 23548 - RNA, 20 nt, Artificial Sequence
  targeting sequence with TTCN PAM
ggggugcaucucucccuugg

SEQ ID NO: 23549 - RNA, 20 nt, Artificial Sequence
  targeting sequence with TTCN PAM
caacuauguagcuucagggc

SEQ ID NO: 23550 - RNA, 20 nt, Artificial Sequence
  targeting sequence with TTCN PAM
gggcaaguucucuuucuuuc

SEQ ID NO: 23551 - RNA, 20 nt, Artificial Sequence
  targeting sequence with TTCN PAM
cuuucuuucuuuuucuuucu

SEQ ID NO: 23552 - RNA, 20 nt, Artificial Sequence
  targeting sequence with TTCN PAM
uucuuuuucuuucuuucucu

SEQ ID NO: 23553 - RNA, 20 nt, Artificial Sequence
  targeting sequence with TTCN PAM
uuuucuuucuuucucuuucu

SEQ ID NO: 23554 - RNA, 20 nt, Artificial Sequence
  targeting sequence with TTCN PAM
uucuuucucuuucuuucuuu

SEQ ID NO: 23555 - RNA, 20 nt, Artificial Sequence
  targeting sequence with TTCN PAM
uucucuuucuuucuuucuuu

SEQ ID NO: 23556 - RNA, 20 nt, Artificial Sequence
  targeting sequence with TTCN PAM
cuuucuuucuuucuuucuuu

SEQ ID NO: 23557 - RNA, 20 nt, Artificial Sequence
  targeting sequence with TTCN PAM
uucuuucuuucuuucuuucu

SEQ ID NO: 23558 - RNA, 20 nt, Artificial Sequence
  targeting sequence with TTCN PAM
uucuuucuuucuuucuuucu

SEQ ID NO: 23559 - RNA, 20 nt, Artificial Sequence
  targeting sequence with TTCN PAM
uucuuucuuucuuucuuucu

SEQ ID NO: 23560 - RNA, 20 nt, Artificial Sequence
  targeting sequence with TTCN PAM
uucuuucuuucuuucuuucu

SEQ ID NO: 23561 - RNA, 20 nt, Artificial Sequence
  targeting sequence with TTCN PAM
uucuuucuuucuuucuuucu

SEQ ID NO: 23562 - RNA, 20 nt, Artificial Sequence
  targeting sequence with TTCN PAM
uucuuucuuucuuucuuucu

SEQ ID NO: 23563 - RNA, 20 nt, Artificial Sequence
  targeting sequence with TTCN PAM
uucuuucuuucuuucuuucu

SEQ ID NO: 23564 - RNA, 20 nt, Artificial Sequence
  targeting sequence with TTCN PAM
uucuuucuuucuuucuuucu

SEQ ID NO: 23565 - RNA, 20 nt, Artificial Sequence
  targeting sequence with TTCN PAM
uucuuucuuucuuucuuucu

SEQ ID NO: 23566 - RNA, 20 nt, Artificial Sequence
  targeting sequence with TTCN PAM
uucuuucuuucuuucuuucu

SEQ ID NO: 23567 - RNA, 20 nt, Artificial Sequence
  targeting sequence with TTCN PAM
uucuuucuuucuuucuuucu

SEQ ID NO: 23568 - RNA, 20 nt, Artificial Sequence
  targeting sequence with TTCN PAM
uucuuucuuucuuucuuucu

SEQ ID NO: 23569 - RNA, 20 nt, Artificial Sequence
  targeting sequence with TTCN PAM
uucuuucuuucuuucuuucu

SEQ ID NO: 23570 - RNA, 20 nt, Artificial Sequence
  targeting sequence with TTCN PAM
uucuuucuuucuuucuuucu

SEQ ID NO: 23571 - RNA, 20 nt, Artificial Sequence
  targeting sequence with TTCN PAM
uucuuucuuucuuucuuucu

SEQ ID NO: 23572 - RNA, 20 nt, Artificial Sequence
  targeting sequence with TTCN PAM
uucuuucuuucuuucuuugc

SEQ ID NO: 23573 - RNA, 20 nt, Artificial Sequence
  targeting sequence with TTCN PAM
uucuuucuuucuuugcuccu

SEQ ID NO: 23574 - RNA, 20 nt, Artificial Sequence
  targeting sequence with TTCN PAM
uucuuucuuugcuccuuccu

SEQ ID NO: 23575 - RNA, 20 nt, Artificial Sequence
  targeting sequence with TTCN PAM
uucuuugcuccuuccuuccu

SEQ ID NO: 23576 - RNA, 20 nt, Artificial Sequence
  targeting sequence with TTCN PAM
uugcuccuuccuuccuuccu

SEQ ID NO: 23577 - RNA, 20 nt, Artificial Sequence
  targeting sequence with TTCN PAM
uuccuuccuugcuucuuucu

SEQ ID NO: 23578 - RNA, 20 nt, Artificial Sequence
  targeting sequence with TTCN PAM
uuccuugcuucuuucuuucu

SEQ ID NO: 23579 - RNA, 20 nt, Artificial Sequence
  targeting sequence with TTCN PAM
uugcuucuuucuuucuuucu

SEQ ID NO: 23580 - RNA, 20 nt, Artificial Sequence
  targeting sequence with TTCN PAM
uucuuucuuucuucuuuuuc

SEQ ID NO: 23581 - RNA, 20 nt, Artificial Sequence
  targeting sequence with TTCN PAM
uucuuucuucuuuuucuuuu

SEQ ID NO: 23582 - RNA, 20 nt, Artificial Sequence
  targeting sequence with TTCN PAM
uucuucuuuuucuuuucuuu

SEQ ID NO: 23583 - RNA, 20 nt, Artificial Sequence
  targeting sequence with TTCN PAM
ucuuuuucuuuucuuuuuuu

SEQ ID NO: 23584 - RNA, 20 nt, Artificial Sequence
  targeting sequence with TTCN PAM
uuuucuuuucuuuuuuuuuu

SEQ ID NO: 23585 - RNA, 20 nt, Artificial Sequence
  targeting sequence with TTCN PAM
uuucuuuuuuuuuuuugaga

SEQ ID NO: 23586 - RNA, 20 nt, Artificial Sequence
  targeting sequence with TTCN PAM
uuuuuuuuuuugagaugggg

SEQ ID NO: 23587 - RNA, 20 nt, Artificial Sequence
  targeting sequence with TTCN PAM
caguuucaagcaauccuucu

SEQ ID NO: 23588 - RNA, 20 nt, Artificial Sequence
  targeting sequence with TTCN PAM
agcaauccuucugucucagc

SEQ ID NO: 23589 - RNA, 20 nt, Artificial Sequence
  targeting sequence with TTCN PAM
gucucagccucucaaguagc

SEQ ID NO: 23590 - RNA, 20 nt, Artificial Sequence
  targeting sequence with TTCN PAM
aaaccagccugggcaacaua

SEQ ID NO: 23591 - RNA, 20 nt, Artificial Sequence
  targeting sequence with TTCN PAM
agccucaaacgauccuccug

SEQ ID NO: 23592 - RNA, 20 nt, Artificial Sequence
  targeting sequence with TTCN PAM
aggacuugcccaaaccaagu

SEQ ID NO: 23593 - RNA, 20 nt, Artificial Sequence
  targeting sequence with TTCN PAM
cuccuuuauagcugaggggc

SEQ ID NO: 23594 - RNA, 20 nt, Artificial Sequence
  targeting sequence with TTCN PAM
accaagugggauaauucucu

SEQ ID NO: 23595 - RNA, 20 nt, Artificial Sequence
  targeting sequence with TTCN PAM
auaaaugugaauucccuucc

SEQ ID NO: 23596 - RNA, 20 nt, Artificial Sequence
  targeting sequence with TTCN PAM
cauuuauugaaugucuacug

SEQ ID NO: 23597 - RNA, 20 nt, Artificial Sequence
  targeting sequence with TTCN PAM
cuucccagagacaugaacua

SEQ ID NO: 23598 - RNA, 20 nt, Artificial Sequence
  targeting sequence with TTCN PAM
cagagacaugaacuaaguuc

SEQ ID NO: 23599 - RNA, 20 nt, Artificial Sequence
  targeting sequence with TTCN PAM
ugucucugggaagggaauuc

SEQ ID NO: 23600 - RNA, 20 nt, Artificial Sequence
  targeting sequence with TTCN PAM
gaggaggcagccgcuugugu

SEQ ID NO: 23601 - RNA, 20 nt, Artificial Sequence
  targeting sequence with TTCN PAM
caccacacaagcggcugccu

SEQ ID NO: 23602 - RNA, 20 nt, Artificial Sequence
  targeting sequence with TTCN PAM
ccacuuuugcaagacccccc

SEQ ID NO: 23603 - RNA, 20 nt, Artificial Sequence
  targeting sequence with TTCN PAM
uucccuuuccuucuauuaac

SEQ ID NO: 23604 - RNA, 20 nt, Artificial Sequence
  targeting sequence with TTCN PAM
cuuuccuucuauuaacaaua

SEQ ID NO: 23605 - RNA, 20 nt, Artificial Sequence
  targeting sequence with TTCN PAM
uucuauuaacaauaucaucc

SEQ ID NO: 23606 - RNA, 20 nt, Artificial Sequence
  targeting sequence with TTCN PAM
auuaacaauaucauccuagg

SEQ ID NO: 23607 - RNA, 20 nt, Artificial Sequence
  targeting sequence with TTCN PAM
agcugggcaccugguugcuc

SEQ ID NO: 23608 - RNA, 20 nt, Artificial Sequence
  targeting sequence with TTCN PAM
gcuucuuuugcaccuguggu

SEQ ID NO: 23609 - RNA, 20 nt, Artificial Sequence
  targeting sequence with TTCN PAM
uuugcaccugugguggcagg

SEQ ID NO: 23610 - RNA, 20 nt, Artificial Sequence
  targeting sequence with TTCN PAM
gaguacccuacaaugacugg

SEQ ID NO: 23611 - RNA, 20 nt, Artificial Sequence
  targeting sequence with TTCN PAM
ccaaaaugcacaaccuagag

SEQ ID NO: 23612 - RNA, 20 nt, Artificial Sequence
  targeting sequence with TTCN PAM
auucuccaaaaugcacaacc

SEQ ID NO: 23613 - RNA, 20 nt, Artificial Sequence
  targeting sequence with TTCN PAM
ucucaucuuuucuuccugcu

SEQ ID NO: 23614 - RNA, 20 nt, Artificial Sequence
  targeting sequence with TTCN PAM
uccugcuggcuggaaagcag

SEQ ID NO: 23615 - RNA, 20 nt, Artificial Sequence
  targeting sequence with TTCN PAM
ugcuggcuggaaagcaguca

SEQ ID NO: 23616 - RNA, 20 nt, Artificial Sequence
  targeting sequence with TTCN PAM
agccagcaggaagaaaagau

SEQ ID NO: 23617 - RNA, 20 nt, Artificial Sequence
  targeting sequence with TTCN PAM
gcacccauauuagaucauga

SEQ ID NO: 23618 - RNA, 20 nt, Artificial Sequence
  targeting sequence with TTCN PAM
aucucaugaucuaauauggg

SEQ ID NO: 23619 - RNA, 20 nt, Artificial Sequence
  targeting sequence with TTCN PAM
cuguccucagauucuaucuc

SEQ ID NO: 23620 - RNA, 20 nt, Artificial Sequence
  targeting sequence with TTCN PAM
cuggugugucucaccauggu

SEQ ID NO: 23621 - RNA, 20 nt, Artificial Sequence
  targeting sequence with TTCN PAM
cccaugcugccuuaacagcc

SEQ ID NO: 23622 - RNA, 20 nt, Artificial Sequence
  targeting sequence with TTCN PAM
agagggaagaguuucauggu

SEQ ID NO: 23623 - RNA, 20 nt, Artificial Sequence
  targeting sequence with TTCN PAM
cucuugaaacucuuuaagca

SEQ ID NO: 23624 - RNA, 20 nt, Artificial Sequence
  targeting sequence with TTCN PAM
ugguuucuuguuuaagucac

SEQ ID NO: 23625 - RNA, 20 nt, Artificial Sequence
  targeting sequence with TTCN PAM
uguuuaagucacuugugauu

SEQ ID NO: 23626 - RNA, 20 nt, Artificial Sequence
  targeting sequence with TTCN PAM
uuuccuuccuuccuuucccu

SEQ ID NO: 23627 - RNA, 20 nt, Artificial Sequence
  targeting sequence with TTCN PAM
uuccuuccuuucccucccuc

SEQ ID NO: 23628 - RNA, 20 nt, Artificial Sequence
  targeting sequence with TTCN PAM
uuccuuucccucccucccuc

SEQ ID NO: 23629 - RNA, 20 nt, Artificial Sequence
  targeting sequence with TTCN PAM
uuucccucccucccucccuc

SEQ ID NO: 23630 - RNA, 20 nt, Artificial Sequence
  targeting sequence with TTCN PAM
cucccucccucccucccucc

SEQ ID NO: 23631 - RNA, 20 nt, Artificial Sequence
  targeting sequence with TTCN PAM
uuccuuccuuccuuccuucc

SEQ ID NO: 23632 - RNA, 20 nt, Artificial Sequence
  targeting sequence with TTCN PAM
uuccuuccuuccuuccuuuc

SEQ ID NO: 23633 - RNA, 20 nt, Artificial Sequence
  targeting sequence with TTCN PAM
uuccuuccuuccuuuccuuc

SEQ ID NO: 23634 - RNA, 20 nt, Artificial Sequence
  targeting sequence with TTCN PAM
uuccuuccuuuccuucuuuc

SEQ ID NO: 23635 - RNA, 20 nt, Artificial Sequence
  targeting sequence with TTCN PAM
uuccuuuccuucuuucuuuu

SEQ ID NO: 23636 - RNA, 20 nt, Artificial Sequence
  targeting sequence with TTCN PAM
uuuccuucuuucuuuucuga

SEQ ID NO: 23637 - RNA, 20 nt, Artificial Sequence
  targeting sequence with TTCN PAM
uucuuucuuuucugagacag

SEQ ID NO: 23638 - RNA, 20 nt, Artificial Sequence
  targeting sequence with TTCN PAM
uucuuuucugagacagaguc

SEQ ID NO: 23639 - RNA, 20 nt, Artificial Sequence
  targeting sequence with TTCN PAM
uuucugagacagagucuugc

SEQ ID NO: 23640 - RNA, 20 nt, Artificial Sequence
  targeting sequence with TTCN PAM
gagacagagucuugcucuau

SEQ ID NO: 23641 - RNA, 20 nt, Artificial Sequence
  targeting sequence with TTCN PAM
agcaauucuccugccucagc

SEQ ID NO: 23642 - RNA, 20 nt, Artificial Sequence
  targeting sequence with TTCN PAM
ccugccucagccucccgagu

SEQ ID NO: 23643 - RNA, 20 nt, Artificial Sequence
  targeting sequence with TTCN PAM
agaucagccugggcaacaug

SEQ ID NO: 23644 - RNA, 20 nt, Artificial Sequence
  targeting sequence with TTCN PAM
uuacuaaaacaaagggcuuc

SEQ ID NO: 23645 - RNA, 20 nt, Artificial Sequence
  targeting sequence with TTCN PAM
aggcugcagcccaggaacuc

SEQ ID NO: 23646 - RNA, 20 nt, Artificial Sequence
  targeting sequence with TTCN PAM
ugggcugcagccuggaagcc

SEQ ID NO: 23647 - RNA, 20 nt, Artificial Sequence
  targeting sequence with TTCN PAM
ugaguuccugggcugcagcc

SEQ ID NO: 23648 - RNA, 20 nt, Artificial Sequence
  targeting sequence with TTCN PAM
aucuuccugaguuccugggc

SEQ ID NO: 23649 - RNA, 20 nt, Artificial Sequence
  targeting sequence with TTCN PAM
gagaggaccugcacuucgau

SEQ ID NO: 23650 - RNA, 20 nt, Artificial Sequence
  targeting sequence with TTCN PAM
gcuucuccauguauaaauaa

SEQ ID NO: 23651 - RNA, 20 nt, Artificial Sequence
  targeting sequence with TTCN PAM
ccauguauaaauaaaauagu

SEQ ID NO: 23652 - RNA, 20 nt, Artificial Sequence
  targeting sequence with TTCN PAM
cuauuuuauuuauacaugga

SEQ ID NO: 23653 - RNA, 20 nt, Artificial Sequence
  targeting sequence with TTCN PAM
acauccauguaaauauuuua

SEQ ID NO: 23654 - RNA, 20 nt, Artificial Sequence
  targeting sequence with TTCN PAM
accccgcccuuuauauauuu

SEQ ID NO: 23655 - RNA, 20 nt, Artificial Sequence
  targeting sequence with TTCN PAM
ugacuuuuagucaauaaaua

SEQ ID NO: 23656 - RNA, 20 nt, Artificial Sequence
  targeting sequence with TTCN PAM
uuccugacuuuuagucaaua

SEQ ID NO: 23657 - RNA, 20 nt, Artificial Sequence
  targeting sequence with TTCN PAM
aaaaguucagaacugugauc

SEQ ID NO: 23658 - RNA, 20 nt, Artificial Sequence
  targeting sequence with TTCN PAM
gaacugugaucuucagaacu

SEQ ID NO: 23659 - RNA, 20 nt, Artificial Sequence
  targeting sequence with TTCN PAM
gaacuuuuggaagcaguuuu

SEQ ID NO: 23660 - RNA, 20 nt, Artificial Sequence
  targeting sequence with TTCN PAM
gaacuguagggcaguucaca

SEQ ID NO: 23661 - RNA, 20 nt, Artificial Sequence
  targeting sequence with TTCN PAM
gaagaucacaguucugaacu

SEQ ID NO: 23662 - RNA, 20 nt, Artificial Sequence
  targeting sequence with TTCN PAM
cauguaggcugaccccauuc

SEQ ID NO: 23663 - RNA, 20 nt, Artificial Sequence
  targeting sequence with TTCN PAM
guguuucauaacuaguucuc

SEQ ID NO: 23664 - RNA, 20 nt, Artificial Sequence
  targeting sequence with TTCN PAM
uaacuaguucucagcagaag

SEQ ID NO: 23665 - RNA, 20 nt, Artificial Sequence
  targeting sequence with TTCN PAM
cagcagaaguuacauuucau

SEQ ID NO: 23666 - RNA, 20 nt, Artificial Sequence
  targeting sequence with TTCN PAM
gcugagaacuaguuaugaaa

SEQ ID NO: 23667 - RNA, 20 nt, Artificial Sequence
  targeting sequence with TTCN PAM
uacaggccucaguaaaaaau

SEQ ID NO: 23668 - RNA, 20 nt, Artificial Sequence
  targeting sequence with TTCN PAM
gugauuuuuuacugaggccu

SEQ ID NO: 23669 - RNA, 20 nt, Artificial Sequence
  targeting sequence with TTCN PAM
gagcaucagacugcagggac

SEQ ID NO: 23670 - RNA, 20 nt, Artificial Sequence
  targeting sequence with TTCN PAM
cuguaaaaaggcaauccucu

SEQ ID NO: 23671 - RNA, 20 nt, Artificial Sequence
  targeting sequence with TTCN PAM
ucuagaggauugccuuuuua

SEQ ID NO: 23672 - RNA, 20 nt, Artificial Sequence
  targeting sequence with TTCN PAM
ucccuucaaaugcgaaacuu

SEQ ID NO: 23673 - RNA, 20 nt, Artificial Sequence
  targeting sequence with TTCN PAM
cuucaaaugcgaaacuugau

SEQ ID NO: 23674 - RNA, 20 nt, Artificial Sequence
  targeting sequence with TTCN PAM
aaugcgaaacuugauccugg

SEQ ID NO: 23675 - RNA, 20 nt, Artificial Sequence
  targeting sequence with TTCN PAM
cauuugaagggaagaagcuc

SEQ ID NO: 23676 - RNA, 20 nt, Artificial Sequence
  targeting sequence with TTCN PAM
gaagaagcucgugggaaugu

SEQ ID NO: 23677 - RNA, 20 nt, Artificial Sequence
  targeting sequence with TTCN PAM
gaaaccaugcucccggcugu

SEQ ID NO: 23678 - RNA, 20 nt, Artificial Sequence
  targeting sequence with TTCN PAM
uccgaaaccaugcucccggc

SEQ ID NO: 23679 - RNA, 20 nt, Artificial Sequence
  targeting sequence with TTCN PAM
cacgagcuucuuccgaaacc

SEQ ID NO: 23680 - RNA, 20 nt, Artificial Sequence
  targeting sequence with TTCN PAM
aucacugaguguugcucuac

SEQ ID NO: 23681 - RNA, 20 nt, Artificial Sequence
  targeting sequence with TTCN PAM
caguucuuggaaguguccca

SEQ ID NO: 23682 - RNA, 20 nt, Artificial Sequence
  targeting sequence with TTCN PAM
uggaagugucccauaaaugu

SEQ ID NO: 23683 - RNA, 20 nt, Artificial Sequence
  targeting sequence with TTCN PAM
aagaacugagaaguagagca

SEQ ID NO: 23684 - RNA, 20 nt, Artificial Sequence
  targeting sequence with TTCN PAM
auuugccucuuugcuucguc

SEQ ID NO: 23685 - RNA, 20 nt, Artificial Sequence
  targeting sequence with TTCN PAM
ucuucugcuccagcauaguc

SEQ ID NO: 23686 - RNA, 20 nt, Artificial Sequence
  targeting sequence with TTCN PAM
gcuccagcauagucccggaa

SEQ ID NO: 23687 - RNA, 20 nt, Artificial Sequence
  targeting sequence with TTCN PAM
gggacuaugcuggagcagaa

SEQ ID NO: 23688 - RNA, 20 nt, Artificial Sequence
  targeting sequence with TTCN PAM
ggccuccagcacugggaccu

SEQ ID NO: 23689 - RNA, 20 nt, Artificial Sequence
  targeting sequence with TTCN PAM
uggugguaucccuggugccc

SEQ ID NO: 23690 - RNA, 20 nt, Artificial Sequence
  targeting sequence with TTCN PAM
gugucuccagccuuugcgcu

SEQ ID NO: 23691 - RNA, 20 nt, Artificial Sequence
  targeting sequence with TTCN PAM
gagcgcuugaggcucuccag

SEQ ID NO: 23692 - RNA, 20 nt, Artificial Sequence
  targeting sequence with TTCN PAM
agaggccagggaaggcuuuu

SEQ ID NO: 23693 - RNA, 20 nt, Artificial Sequence
  targeting sequence with TTCN PAM
cuggccucuagaagguuagg

SEQ ID NO: 23694 - RNA, 20 nt, Artificial Sequence
  targeting sequence with TTCN PAM
gaagaugcggcaucuacucu

SEQ ID NO: 23695 - RNA, 20 nt, Artificial Sequence
  targeting sequence with TTCN PAM
gaaaagccuucccuggccuc

SEQ ID NO: 23696 - RNA, 20 nt, Artificial Sequence
  targeting sequence with TTCN PAM
cacucaucuuuuggccucag

SEQ ID NO: 23697 - RNA, 20 nt, Artificial Sequence
  targeting sequence with TTCN PAM
cuggacucuuucccacucau

SEQ ID NO: 23698 - RNA, 20 nt, Artificial Sequence
  targeting sequence with TTCN PAM
aaggccaaguguaucaauug

SEQ ID NO: 23699 - RNA, 20 nt, Artificial Sequence
  targeting sequence with TTCN PAM
uggcuuaaaacaacaagcug

SEQ ID NO: 23700 - RNA, 20 nt, Artificial Sequence
  targeting sequence with TTCN PAM
ugacucuggaucagccaggc

SEQ ID NO: 23701 - RNA, 20 nt, Artificial Sequence
  targeting sequence with TTCN PAM
gaucagcagaucugccuggc

SEQ ID NO: 23702 - RNA, 20 nt, Artificial Sequence
  targeting sequence with TTCN PAM
gcuggguucauucaagcauc

SEQ ID NO: 23703 - RNA, 20 nt, Artificial Sequence
  targeting sequence with TTCN PAM
uucaagcaucuguggucaac

SEQ ID NO: 23704 - RNA, 20 nt, Artificial Sequence
  targeting sequence with TTCN PAM
agcaucuguggucaacugga

SEQ ID NO: 23705 - RNA, 20 nt, Artificial Sequence
  targeting sequence with TTCN PAM
gcuauuggucaaagcaaguc

SEQ ID NO: 23706 - RNA, 20 nt, Artificial Sequence
  targeting sequence with TTCN PAM
uuaaaucuuaugacuugcuu

SEQ ID NO: 23707 - RNA, 20 nt, Artificial Sequence
  targeting sequence with TTCN PAM
uaagucugaguggauuccuu

SEQ ID NO: 23708 - RNA, 20 nt, Artificial Sequence
  targeting sequence with TTCN PAM
agaccagccugggcaacaug

SEQ ID NO: 23709 - RNA, 20 nt, Artificial Sequence
  targeting sequence with TTCN PAM
aauauauauacauacauaua

SEQ ID NO: 23710 - RNA, 20 nt, Artificial Sequence
  targeting sequence with TTCN PAM
aaguggcuaggacucaggca

SEQ ID NO: 23711 - RNA, 20 nt, Artificial Sequence
  targeting sequence with TTCN PAM
gucuuccaaguggcuaggac

SEQ ID NO: 23712 - RNA, 20 nt, Artificial Sequence
  targeting sequence with TTCN PAM
gggcucaagugaucuccuac

SEQ ID NO: 23713 - RNA, 20 nt, Artificial Sequence
  targeting sequence with TTCN PAM
acucugucgcccaggcugga

SEQ ID NO: 23714 - RNA, 20 nt, Artificial Sequence
  targeting sequence with TTCN PAM
uguuuguuuguuuguuuuuu

SEQ ID NO: 23715 - RNA, 20 nt, Artificial Sequence
  targeting sequence with TTCN PAM
cuccugcccauuugcaaugu

SEQ ID NO: 23716 - RNA, 20 nt, Artificial Sequence
  targeting sequence with TTCN PAM
gcaucaauucaacacacaca

SEQ ID NO: 23717 - RNA, 20 nt, Artificial Sequence
  targeting sequence with TTCN PAM
acacacacagaggagacaaa

SEQ ID NO: 23718 - RNA, 20 nt, Artificial Sequence
  targeting sequence with TTCN PAM
aggagccgcaguguggguga

SEQ ID NO: 23719 - RNA, 20 nt, Artificial Sequence
  targeting sequence with TTCN PAM
cccacacugcggcuccugga

SEQ ID NO: 23720 - RNA, 20 nt, Artificial Sequence
  targeting sequence with TTCN PAM
agcggggaggaggcuccuua

SEQ ID NO: 23721 - RNA, 20 nt, Artificial Sequence
  targeting sequence with TTCN PAM
gucugacuuaaggagccucc

SEQ ID NO: 23722 - RNA, 20 nt, Artificial Sequence
  targeting sequence with TTCN PAM
ugcucuucagucugacuuaa

SEQ ID NO: 23723 - RNA, 20 nt, Artificial Sequence
  targeting sequence with TTCN PAM
cccacgggcaguggggagcc

SEQ ID NO: 23724 - RNA, 20 nt, Artificial Sequence
  targeting sequence with TTCN PAM
cucccccgcuuagcauccug

SEQ ID NO: 23725 - RNA, 20 nt, Artificial Sequence
  targeting sequence with TTCN PAM
cuuuagaacacuuugaugac

SEQ ID NO: 23726 - RNA, 20 nt, Artificial Sequence
  targeting sequence with TTCN PAM
aaagugaagucagauuucac

SEQ ID NO: 23727 - RNA, 20 nt, Artificial Sequence
  targeting sequence with TTCN PAM
cagagggcucuccaucacca

SEQ ID NO: 23728 - RNA, 20 nt, Artificial Sequence
  targeting sequence with TTCN PAM
acaauaaagagacuaccuag

SEQ ID NO: 23729 - RNA, 20 nt, Artificial Sequence
  targeting sequence with TTCN PAM
cuagguagucucuuuauugu

SEQ ID NO: 23730 - RNA, 20 nt, Artificial Sequence
  targeting sequence with TTCN PAM
ucucuagguagucucuuuau

SEQ ID NO: 23731 - RNA, 20 nt, Artificial Sequence
  targeting sequence with TTCN PAM
ucagagguaaccacuucuac

SEQ ID NO: 23732 - RNA, 20 nt, Artificial Sequence
  targeting sequence with TTCN PAM
acuauuaccuugguaugaau

SEQ ID NO: 23733 - RNA, 20 nt, Artificial Sequence
  targeting sequence with TTCN PAM
uaccaagguaauaguagaag

SEQ ID NO: 23734 - RNA, 20 nt, Artificial Sequence
  targeting sequence with TTCN PAM
gaacuuuuuucuacugcuug

SEQ ID NO: 23735 - RNA, 20 nt, Artificial Sequence
  targeting sequence with TTCN PAM
gaauggauucauaccaaggu

SEQ ID NO: 23736 - RNA, 20 nt, Artificial Sequence
  targeting sequence with TTCN PAM
acugcuugugacugguaaga

SEQ ID NO: 23737 - RNA, 20 nt, Artificial Sequence
  targeting sequence with TTCN PAM
uuuuaauuuuuaaaaaauuu

SEQ ID NO: 23738 - RNA, 20 nt, Artificial Sequence
  targeting sequence with TTCN PAM
cacacacacacacacacaca

SEQ ID NO: 23739 - RNA, 20 nt, Artificial Sequence
  targeting sequence with TTCN PAM
caguaguugggguguacucu

SEQ ID NO: 23740 - RNA, 20 nt, Artificial Sequence
  targeting sequence with TTCN PAM
gguucacuccuuuucacuac

SEQ ID NO: 23741 - RNA, 20 nt, Artificial Sequence
  targeting sequence with TTCN PAM
cuccuuuucacuacugcaua

SEQ ID NO: 23742 - RNA, 20 nt, Artificial Sequence
  targeting sequence with TTCN PAM
cuacugcauacuacuccacu

SEQ ID NO: 23743 - RNA, 20 nt, Artificial Sequence
  targeting sequence with TTCN PAM
cacaguggaguaguaugcag

SEQ ID NO: 23744 - RNA, 20 nt, Artificial Sequence
  targeting sequence with TTCN PAM
cucuccaccugaugggcauu

SEQ ID NO: 23745 - RNA, 20 nt, Artificial Sequence
  targeting sequence with TTCN PAM
aaacaacauaaaugcccauc

SEQ ID NO: 23746 - RNA, 20 nt, Artificial Sequence
  targeting sequence with TTCN PAM
gcuaagauugaaauaaacau

SEQ ID NO: 23747 - RNA, 20 nt, Artificial Sequence
  targeting sequence with TTCN PAM
aucuuagcagaaauucaaaa

SEQ ID NO: 23748 - RNA, 20 nt, Artificial Sequence
  targeting sequence with TTCN PAM
acucuaggcguagaucugag

SEQ ID NO: 23749 - RNA, 20 nt, Artificial Sequence
  targeting sequence with TTCN PAM
uacaacuaaggagggacuca

SEQ ID NO: 23750 - RNA, 20 nt, Artificial Sequence
  targeting sequence with TTCN PAM
gcgauguuucauacaacuaa

SEQ ID NO: 23751 - RNA, 20 nt, Artificial Sequence
  targeting sequence with TTCN PAM
aaggcggcuaccagcucacu

SEQ ID NO: 23752 - RNA, 20 nt, Artificial Sequence
  targeting sequence with TTCN PAM
uugaauccuagucacucacu

SEQ ID NO: 23753 - RNA, 20 nt, Artificial Sequence
  targeting sequence with TTCN PAM
aggaaaguauagcugcuggg

SEQ ID NO: 23754 - RNA, 20 nt, Artificial Sequence
  targeting sequence with TTCN PAM
cacucagcaaaaugacaaag

SEQ ID NO: 23755 - RNA, 20 nt, Artificial Sequence
  targeting sequence with TTCN PAM
uguuuguuuucuuuucuuuc

SEQ ID NO: 23756 - RNA, 20 nt, Artificial Sequence
  targeting sequence with TTCN PAM
uuucuuucccucccccuuuu

SEQ ID NO: 23757 - RNA, 20 nt, Artificial Sequence
  targeting sequence with TTCN PAM
uucccucccccuuuuuuuug

SEQ ID NO: 23758 - RNA, 20 nt, Artificial Sequence
  targeting sequence with TTCN PAM
cucccccuuuuuuuuggggg

SEQ ID NO: 23759 - RNA, 20 nt, Artificial Sequence
  targeting sequence with TTCN PAM
cuuuuuugccuaggcugguc

SEQ ID NO: 23760 - RNA, 20 nt, Artificial Sequence
  targeting sequence with TTCN PAM
agaccagccuaggcaaaaaa

SEQ ID NO: 23761 - RNA, 20 nt, Artificial Sequence
  targeting sequence with TTCN PAM
ggaggcugaggcaggaggau

SEQ ID NO: 23762 - RNA, 20 nt, Artificial Sequence
  targeting sequence with TTCN PAM
gggauuacagguaugagcca

SEQ ID NO: 23763 - RNA, 20 nt, Artificial Sequence
  targeting sequence with TTCN PAM
cucuuguugcccaggcugga

SEQ ID NO: 23764 - RNA, 20 nt, Artificial Sequence
  targeting sequence with TTCN PAM
cugcagucuccagcucccag

SEQ ID NO: 23765 - RNA, 20 nt, Artificial Sequence
  targeting sequence with TTCN PAM
agugauucuccugccucagc

SEQ ID NO: 23766 - RNA, 20 nt, Artificial Sequence
  targeting sequence with TTCN PAM
ccugccucagccucccaagu

SEQ ID NO: 23767 - RNA, 20 nt, Artificial Sequence
  targeting sequence with TTCN PAM
ucucuacuaaaaauacaaaa

SEQ ID NO: 23768 - RNA, 20 nt, Artificial Sequence
  targeting sequence with TTCN PAM
gcagccaucuaaaaugacaa

SEQ ID NO: 23769 - RNA, 20 nt, Artificial Sequence
  targeting sequence with TTCN PAM
gcagaaagggugugauuuag

SEQ ID NO: 23770 - RNA, 20 nt, Artificial Sequence
  targeting sequence with TTCN PAM
gcagaauauucugcagccau

SEQ ID NO: 23771 - RNA, 20 nt, Artificial Sequence
  targeting sequence with TTCN PAM
aagcaaacacccaaggccug

SEQ ID NO: 23772 - RNA, 20 nt, Artificial Sequence
  targeting sequence with TTCN PAM
caucaaauugacagacaaaa

SEQ ID NO: 23773 - RNA, 20 nt, Artificial Sequence
  targeting sequence with TTCN PAM
ccauuguuucaauuugaauu

SEQ ID NO: 23774 - RNA, 20 nt, Artificial Sequence
  targeting sequence with TTCN PAM
auuugaauuuucucaaaugc

SEQ ID NO: 23775 - RNA, 20 nt, Artificial Sequence
  targeting sequence with TTCN PAM
aauugaaacaauggugaaau

SEQ ID NO: 23776 - RNA, 20 nt, Artificial Sequence
  targeting sequence with TTCN PAM
caaaugccaaggaaguugag

SEQ ID NO: 23777 - RNA, 20 nt, Artificial Sequence
  targeting sequence with TTCN PAM
uuggcauuugagaaaauuca

SEQ ID NO: 23778 - RNA, 20 nt, Artificial Sequence
  targeting sequence with TTCN PAM
uguuucuguuccucacccuu

SEQ ID NO: 23779 - RNA, 20 nt, Artificial Sequence
  targeting sequence with TTCN PAM
guuccucacccuuuaggcug

SEQ ID NO: 23780 - RNA, 20 nt, Artificial Sequence
  targeting sequence with TTCN PAM
ucacccuuuaggcuggugaa

SEQ ID NO: 23781 - RNA, 20 nt, Artificial Sequence
  targeting sequence with TTCN PAM
ccagccuaaagggugaggaa

SEQ ID NO: 23782 - RNA, 20 nt, Artificial Sequence
  targeting sequence with TTCN PAM
uuguccauugucccagugga

SEQ ID NO: 23783 - RNA, 20 nt, Artificial Sequence
  targeting sequence with TTCN PAM
uagauaaggacaacauccac

SEQ ID NO: 23784 - RNA, 20 nt, Artificial Sequence
  targeting sequence with TTCN PAM
caaaagucuucauagauaag

SEQ ID NO: 23785 - RNA, 20 nt, Artificial Sequence
  targeting sequence with TTCN PAM
uuaaaaacaaaaccaaagga

SEQ ID NO: 23786 - RNA, 20 nt, Artificial Sequence
  targeting sequence with TTCN PAM
gaggccagccaggcucucug

SEQ ID NO: 23787 - RNA, 20 nt, Artificial Sequence
  targeting sequence with TTCN PAM
caaaaaguagcaguuggagg

SEQ ID NO: 23788 - RNA, 20 nt, Artificial Sequence
  targeting sequence with TTCN PAM
ucaucagcaucuccagcccc

SEQ ID NO: 23789 - RNA, 20 nt, Artificial Sequence
  targeting sequence with TTCN PAM
cugggucucaguccccaugg

SEQ ID NO: 23790 - RNA, 20 nt, Artificial Sequence
  targeting sequence with TTCN PAM
guagggagccccagcuggac

SEQ ID NO: 23791 - RNA, 20 nt, Artificial Sequence
  targeting sequence with TTCN PAM
acaccuccagccccagucag

SEQ ID NO: 23792 - RNA, 20 nt, Artificial Sequence
  targeting sequence with TTCN PAM
acagcaggaucauccagguc

SEQ ID NO: 23793 - RNA, 20 nt, Artificial Sequence
  targeting sequence with TTCN PAM
ggagaccuggaugauccugc

SEQ ID NO: 23794 - RNA, 20 nt, Artificial Sequence
  targeting sequence with TTCN PAM
gauucaggagaccuggauga

SEQ ID NO: 23795 - RNA, 20 nt, Artificial Sequence
  targeting sequence with TTCN PAM
cguucuuucccagccuggcc

SEQ ID NO: 23796 - RNA, 20 nt, Artificial Sequence
  targeting sequence with TTCN PAM
uucccagccuggccccagca

SEQ ID NO: 23797 - RNA, 20 nt, Artificial Sequence
  targeting sequence with TTCN PAM
cagccuggccccagcaccua

SEQ ID NO: 23798 - RNA, 20 nt, Artificial Sequence
  targeting sequence with TTCN PAM
gccaaaaggcaguugagcuc

SEQ ID NO: 23799 - RNA, 20 nt, Artificial Sequence
  targeting sequence with TTCN PAM
cugagcgaggccggccccag

SEQ ID NO: 23800 - RNA, 20 nt, Artificial Sequence
  targeting sequence with TTCN PAM
agcuggagcccguuuccugc

SEQ ID NO: 23801 - RNA, 20 nt, Artificial Sequence
  targeting sequence with TTCN PAM
ugcugggaccguagcccgua

SEQ ID NO: 23802 - RNA, 20 nt, Artificial Sequence
  targeting sequence with TTCN PAM
gauuuucaaccaaaaaacac

SEQ ID NO: 23803 - RNA, 20 nt, Artificial Sequence
  targeting sequence with TTCN PAM
accaaaaaacaccucagggu

SEQ ID NO: 23804 - RNA, 20 nt, Artificial Sequence
  targeting sequence with TTCN PAM
cucccucgaggaccucccgg

SEQ ID NO: 23805 - RNA, 20 nt, Artificial Sequence
  targeting sequence with TTCN PAM
ccaucagaccgggagguccu

SEQ ID NO: 23806 - RNA, 20 nt, Artificial Sequence
  targeting sequence with TTCN PAM
guggcgguaauccagagcug

SEQ ID NO: 23807 - RNA, 20 nt, Artificial Sequence
  targeting sequence with TTCN PAM
cugaccucccagaguggguu

SEQ ID NO: 23808 - RNA, 20 nt, Artificial Sequence
  targeting sequence with TTCN PAM
uagaagaggugacccugaag

SEQ ID NO: 23809 - RNA, 20 nt, Artificial Sequence
  targeting sequence with TTCN PAM
aggaagcuuucccugaccuc

SEQ ID NO: 23810 - RNA, 20 nt, Artificial Sequence
  targeting sequence with TTCN PAM
gggucaccucuucuaggaag

SEQ ID NO: 23811 - RNA, 20 nt, Artificial Sequence
  targeting sequence with TTCN PAM
cccggcugaggcacacccau

SEQ ID NO: 23812 - RNA, 20 nt, Artificial Sequence
  targeting sequence with TTCN PAM
auuugccaagacaccuaggg

SEQ ID NO: 23813 - RNA, 20 nt, Artificial Sequence
  targeting sequence with TTCN PAM
cggcaccuggacccccuccc

SEQ ID NO: 23814 - RNA, 20 nt, Artificial Sequence
  targeting sequence with TTCN PAM
caguuaacucugcccuuuua

SEQ ID NO: 23815 - RNA, 20 nt, Artificial Sequence
  targeting sequence with TTCN PAM
aggcucaaaaugcaccuugg

SEQ ID NO: 23816 - RNA, 20 nt, Artificial Sequence
  targeting sequence with TTCN PAM
ucugccugggcugccucucu

SEQ ID NO: 23817 - RNA, 20 nt, Artificial Sequence
  targeting sequence with TTCN PAM
gagacaagcugcuggugcgc

SEQ ID NO: 23818 - RNA, 20 nt, Artificial Sequence
  targeting sequence with TTCN PAM
uucugggaaggagggaagug

SEQ ID NO: 23819 - RNA, 20 nt, Artificial Sequence
  targeting sequence with TTCN PAM
gggaaggagggaagugcugg

SEQ ID NO: 23820 - RNA, 20 nt, Artificial Sequence
  targeting sequence with TTCN PAM
cagaaggaagaugcagcuuc

SEQ ID NO: 23821 - RNA, 20 nt, Artificial Sequence
  targeting sequence with TTCN PAM
cuccuucccagaaggaagau

SEQ ID NO: 23822 - RNA, 20 nt, Artificial Sequence
  targeting sequence with TTCN PAM
guuaggucaacuuuuaucuu

SEQ ID NO: 23823 - RNA, 20 nt, Artificial Sequence
  targeting sequence with TTCN PAM
agauaaaaguugaccuaacu

SEQ ID NO: 23824 - RNA, 20 nt, Artificial Sequence
  targeting sequence with TTCN PAM
agcagggaggugaggggugu

SEQ ID NO: 23825 - RNA, 20 nt, Artificial Sequence
  targeting sequence with TTCN PAM
ccucgcuguaucucacaccc

SEQ ID NO: 23826 - RNA, 20 nt, Artificial Sequence
  targeting sequence with TTCN PAM
ccaccgcaugcauucuccuc

SEQ ID NO: 23827 - RNA, 20 nt, Artificial Sequence
  targeting sequence with TTCN PAM
ggccucuccucuccaacucc

SEQ ID NO: 23828 - RNA, 20 nt, Artificial Sequence
  targeting sequence with TTCN PAM
cuccauauucuggccucucc

SEQ ID NO: 23829 - RNA, 20 nt, Artificial Sequence
  targeting sequence with TTCN PAM
uccucaccacacccacucga

SEQ ID NO: 23830 - RNA, 20 nt, Artificial Sequence
  targeting sequence with TTCN PAM
gggcccuuuccuccucacca

SEQ ID NO: 23831 - RNA, 20 nt, Artificial Sequence
  targeting sequence with TTCN PAM
ugcuuggauguuggguaggu

SEQ ID NO: 23832 - RNA, 20 nt, Artificial Sequence
  targeting sequence with TTCN PAM
uggaagagagaggaggggca

SEQ ID NO: 23833 - RNA, 20 nt, Artificial Sequence
  targeting sequence with TTCN PAM
aggaaugccccaugccccca

SEQ ID NO: 23834 - RNA, 20 nt, Artificial Sequence
  targeting sequence with TTCN PAM
ggacauccugguauacagca

SEQ ID NO: 23835 - RNA, 20 nt, Artificial Sequence
  targeting sequence with TTCN PAM
augccugcuguauaccagga

SEQ ID NO: 23836 - RNA, 20 nt, Artificial Sequence
  targeting sequence with TTCN PAM
gcagcuauuccaugccugcu

SEQ ID NO: 23837 - RNA, 20 nt, Artificial Sequence
  targeting sequence with TTCN PAM
cucucaucccagccccucau

SEQ ID NO: 23838 - RNA, 20 nt, Artificial Sequence
  targeting sequence with TTCN PAM
cccagaccaugucuguccca

SEQ ID NO: 23839 - RNA, 20 nt, Artificial Sequence
  targeting sequence with TTCN PAM
cgagcagcuccaaccccucc

SEQ ID NO: 23840 - RNA, 20 nt, Artificial Sequence
  targeting sequence with TTCN PAM
cuuggccugacuucacgagc

SEQ ID NO: 23841 - RNA, 20 nt, Artificial Sequence
  targeting sequence with TTCN PAM
caagggucuucgcuuggccu

SEQ ID NO: 23842 - RNA, 20 nt, Artificial Sequence
  targeting sequence with TTCN PAM
cauccguacaguggggacgg

SEQ ID NO: 23843 - RNA, 20 nt, Artificial Sequence
  targeting sequence with TTCN PAM
cucuaggccucagucuuccc

SEQ ID NO: 23844 - RNA, 20 nt, Artificial Sequence
  targeting sequence with TTCN PAM
ucccucuaggccucagucuu

SEQ ID NO: 23845 - RNA, 20 nt, Artificial Sequence
  targeting sequence with TTCN PAM
uucuucccucuaggccucag

SEQ ID NO: 23846 - RNA, 20 nt, Artificial Sequence
  targeting sequence with TTCN PAM
cgggaguuucauucuucccu

SEQ ID NO: 23847 - RNA, 20 nt, Artificial Sequence
  targeting sequence with TTCN PAM
uuugggggccaaaggcguug

SEQ ID NO: 23848 - RNA, 20 nt, Artificial Sequence
  targeting sequence with TTCN PAM
cacacugggcucgucauggc

SEQ ID NO: 23849 - RNA, 20 nt, Artificial Sequence
  targeting sequence with TTCN PAM
accccuguuggguccuggcc

SEQ ID NO: 23850 - RNA, 20 nt, Artificial Sequence
  targeting sequence with TTCN PAM
ugguuuuuuuuuucuauuga

SEQ ID NO: 23851 - RNA, 20 nt, Artificial Sequence
  targeting sequence with TTCN PAM
auugaaaaaaaauuuuaaua

SEQ ID NO: 23852 - RNA, 20 nt, Artificial Sequence
  targeting sequence with TTCN PAM
auagaaaaaaaaaaccauga

SEQ ID NO: 23853 - RNA, 20 nt, Artificial Sequence
  targeting sequence with TTCN PAM
caggcucaagcaaucuuccc

SEQ ID NO: 23854 - RNA, 20 nt, Artificial Sequence
  targeting sequence with TTCN PAM
caccucagccucccaaguag

SEQ ID NO: 23855 - RNA, 20 nt, Artificial Sequence
  targeting sequence with TTCN PAM
uagagucgaggucucacgau

SEQ ID NO: 23856 - RNA, 20 nt, Artificial Sequence
  targeting sequence with TTCN PAM
gggcaauaucgugagaccuc

SEQ ID NO: 23857 - RNA, 20 nt, Artificial Sequence
  targeting sequence with TTCN PAM
gcagauugaucagaaaucaa

SEQ ID NO: 23858 - RNA, 20 nt, Artificial Sequence
  targeting sequence with TTCN PAM
gaucaaucugcagaauuuaa

SEQ ID NO: 23859 - RNA, 20 nt, Artificial Sequence
  targeting sequence with TTCN PAM
auucaccacauuuaaauccg

SEQ ID NO: 23860 - RNA, 20 nt, Artificial Sequence
  targeting sequence with TTCN PAM
ccacauuuaaauccgguuuc

SEQ ID NO: 23861 - RNA, 20 nt, Artificial Sequence
  targeting sequence with TTCN PAM
uauuuaaaucccuuuuaugc

SEQ ID NO: 23862 - RNA, 20 nt, Artificial Sequence
  targeting sequence with TTCN PAM
uggugacugacaacuucuca

SEQ ID NO: 23863 - RNA, 20 nt, Artificial Sequence
  targeting sequence with TTCN PAM
caugcuucccccacccuuga

SEQ ID NO: 23864 - RNA, 20 nt, Artificial Sequence
  targeting sequence with TTCN PAM
cccacccuugaucccacuuc

SEQ ID NO: 23865 - RNA, 20 nt, Artificial Sequence
  targeting sequence with TTCN PAM
uuugcaacuauuuuauaaca

SEQ ID NO: 23866 - RNA, 20 nt, Artificial Sequence
  targeting sequence with TTCN PAM
caauaagguguuauaaaaua

SEQ ID NO: 23867 - RNA, 20 nt, Artificial Sequence
  targeting sequence with TTCN PAM
cauacaauacaauucacccu

SEQ ID NO: 23868 - RNA, 20 nt, Artificial Sequence
  targeting sequence with TTCN PAM
cccuuuaaaguguacaaugg

SEQ ID NO: 23869 - RNA, 20 nt, Artificial Sequence
  targeting sequence with TTCN PAM
aaaauugauuauagagaugg

SEQ ID NO: 23870 - RNA, 20 nt, Artificial Sequence
  targeting sequence with TTCN PAM
ucacuucaagaaaaccagua

SEQ ID NO: 23871 - RNA, 20 nt, Artificial Sequence
  targeting sequence with TTCN PAM
agaaaaccaguacccauuag

SEQ ID NO: 23872 - RNA, 20 nt, Artificial Sequence
  targeting sequence with TTCN PAM
ugaagugaugaaaauauucu

SEQ ID NO: 23873 - RNA, 20 nt, Artificial Sequence
  targeting sequence with TTCN PAM
gcaucuauggacuucuuauu

SEQ ID NO: 23874 - RNA, 20 nt, Artificial Sequence
  targeting sequence with TTCN PAM
uauucuggacauuucauaua

SEQ ID NO: 23875 - RNA, 20 nt, Artificial Sequence
  targeting sequence with TTCN PAM
ggacauuucauauaaaugga

SEQ ID NO: 23876 - RNA, 20 nt, Artificial Sequence
  targeting sequence with TTCN PAM
uauaaauggaaucagacagu

SEQ ID NO: 23877 - RNA, 20 nt, Artificial Sequence
  targeting sequence with TTCN PAM
auuuauaugaaauguccaga

SEQ ID NO: 23878 - RNA, 20 nt, Artificial Sequence
  targeting sequence with TTCN PAM
gacugccuuuuuucacuuug

SEQ ID NO: 23879 - RNA, 20 nt, Artificial Sequence
  targeting sequence with TTCN PAM
cuuugcauguuucagggcuc

SEQ ID NO: 23880 - RNA, 20 nt, Artificial Sequence
  targeting sequence with TTCN PAM
gggcuccuccaugucguagc

SEQ ID NO: 23881 - RNA, 20 nt, Artificial Sequence
  targeting sequence with TTCN PAM
cuccuuuguauggcuggaua

SEQ ID NO: 23882 - RNA, 20 nt, Artificial Sequence
  targeting sequence with TTCN PAM
acgggauggguagcgaccac

SEQ ID NO: 23883 - RNA, 20 nt, Artificial Sequence
  targeting sequence with TTCN PAM
uccaucugucaaucauucau

SEQ ID NO: 23884 - RNA, 20 nt, Artificial Sequence
  targeting sequence with TTCN PAM
ucauggauguuugggcuggu

SEQ ID NO: 23885 - RNA, 20 nt, Artificial Sequence
  targeting sequence with TTCN PAM
aucuuugggccgacaugaau

SEQ ID NO: 23886 - RNA, 20 nt, Artificial Sequence
  targeting sequence with TTCN PAM
ugucggcccaaagauggaac

SEQ ID NO: 23887 - RNA, 20 nt, Artificial Sequence
  targeting sequence with TTCN PAM
uagcagcacuauucaugucg

SEQ ID NO: 23888 - RNA, 20 nt, Artificial Sequence
  targeting sequence with TTCN PAM
uguguacauuuuugugugga

SEQ ID NO: 23889 - RNA, 20 nt, Artificial Sequence
  targeting sequence with TTCN PAM
uuucccucagguauauaccg

SEQ ID NO: 23890 - RNA, 20 nt, Artificial Sequence
  targeting sequence with TTCN PAM
cucagguauauaccgaagag

SEQ ID NO: 23891 - RNA, 20 nt, Artificial Sequence
  targeting sequence with TTCN PAM
guauauaccugagggaaaug

SEQ ID NO: 23892 - RNA, 20 nt, Artificial Sequence
  targeting sequence with TTCN PAM
acucuucgguauauaccuga

SEQ ID NO: 23893 - RNA, 20 nt, Artificial Sequence
  targeting sequence with TTCN PAM
uaauaaaaaguuaccaaaaa

SEQ ID NO: 23894 - RNA, 20 nt, Artificial Sequence
  targeting sequence with TTCN PAM
gggccgagcaugguggcuca

SEQ ID NO: 23895 - RNA, 20 nt, Artificial Sequence
  targeting sequence with TTCN PAM
caccucagucucccaaagug

SEQ ID NO: 23896 - RNA, 20 nt, Artificial Sequence
  targeting sequence with TTCN PAM
agcuaucuucccaccucagu

SEQ ID NO: 23897 - RNA, 20 nt, Artificial Sequence
  targeting sequence with TTCN PAM
gagacugaggcaagaggauc

SEQ ID NO: 23898 - RNA, 20 nt, Artificial Sequence
  targeting sequence with TTCN PAM
aauggauacaaaaguagacu

SEQ ID NO: 23899 - RNA, 20 nt, Artificial Sequence
  targeting sequence with TTCN PAM
acuguacccgucacccagcu

SEQ ID NO: 23900 - RNA, 20 nt, Artificial Sequence
  targeting sequence with TTCN PAM
ucugcuggguuauuucaaag

SEQ ID NO: 23901 - RNA, 20 nt, Artificial Sequence
  targeting sequence with TTCN PAM
aagcaaaugcuggauuuaug

SEQ ID NO: 23902 - RNA, 20 nt, Artificial Sequence
  targeting sequence with TTCN PAM
ucuguaaauaucuuuuauaa

SEQ ID NO: 23903 - RNA, 20 nt, Artificial Sequence
  targeting sequence with TTCN PAM
agugugcuaaugguauuaca

SEQ ID NO: 23904 - RNA, 20 nt, Artificial Sequence
  targeting sequence with TTCN PAM
uuccagugcucacauuuauc

SEQ ID NO: 23905 - RNA, 20 nt, Artificial Sequence
  targeting sequence with TTCN PAM
agugcucacauuuaucuguu

SEQ ID NO: 23906 - RNA, 20 nt, Artificial Sequence
  targeting sequence with TTCN PAM
uuuuccaguuggauuguuca

SEQ ID NO: 23907 - RNA, 20 nt, Artificial Sequence
  targeting sequence with TTCN PAM
aguuggauuguucaaauccu

SEQ ID NO: 23908 - RNA, 20 nt, Artificial Sequence
  targeting sequence with TTCN PAM
aauccugcucugggaaugag

SEQ ID NO: 23909 - RNA, 20 nt, Artificial Sequence
  targeting sequence with TTCN PAM
cagagcaggauuugaacaau

SEQ ID NO: 23910 - RNA, 20 nt, Artificial Sequence
  targeting sequence with TTCN PAM
uaaggaccuuuaguccauag

SEQ ID NO: 23911 - RNA, 20 nt, Artificial Sequence
  targeting sequence with TTCN PAM
uuccccccuuauuuguggaa

SEQ ID NO: 23912 - RNA, 20 nt, Artificial Sequence
  targeting sequence with TTCN PAM
ccccuuauuuguggaagaaa

SEQ ID NO: 23913 - RNA, 20 nt, Artificial Sequence
  targeting sequence with TTCN PAM
acaaauaaggggggaaagaa

SEQ ID NO: 23914 - RNA, 20 nt, Artificial Sequence
  targeting sequence with TTCN PAM
uccacaaauaaggggggaaa

SEQ ID NO: 23915 - RNA, 20 nt, Artificial Sequence
  targeting sequence with TTCN PAM
cagaggcacccagacugaga

SEQ ID NO: 23916 - RNA, 20 nt, Artificial Sequence
  targeting sequence with TTCN PAM
uaacuguggguuuacaggac

SEQ ID NO: 23917 - RNA, 20 nt, Artificial Sequence
  targeting sequence with TTCN PAM
cccaauuuagauuguuuuuc

SEQ ID NO: 23918 - RNA, 20 nt, Artificial Sequence
  targeting sequence with TTCN PAM
aaaggaauacuccauucuuu

SEQ ID NO: 23919 - RNA, 20 nt, Artificial Sequence
  targeting sequence with TTCN PAM
uuuagaaaaacaaucuaaau

SEQ ID NO: 23920 - RNA, 20 nt, Artificial Sequence
  targeting sequence with TTCN PAM
uuaaaaagagagauuuggcu

SEQ ID NO: 23921 - RNA, 20 nt, Artificial Sequence
  targeting sequence with TTCN PAM
agaccagccuggccaacaug

SEQ ID NO: 23922 - RNA, 20 nt, Artificial Sequence
  targeting sequence with TTCN PAM
ccauguuggccaggcugguc

SEQ ID NO: 23923 - RNA, 20 nt, Artificial Sequence
  targeting sequence with TTCN PAM
ccugccucagccucccaagu

SEQ ID NO: 23924 - RNA, 20 nt, Artificial Sequence
  targeting sequence with TTCN PAM
agcaguucuccugccucagc

SEQ ID NO: 23925 - RNA, 20 nt, Artificial Sequence
  targeting sequence with TTCN PAM
uugagacacugucucucuau

SEQ ID NO: 23926 - RNA, 20 nt, Artificial Sequence
  targeting sequence with TTCN PAM
aguaccugcugaagcaggcg

SEQ ID NO: 23927 - RNA, 20 nt, Artificial Sequence
  targeting sequence with TTCN PAM
gcagguacuugaagcggagg

SEQ ID NO: 23928 - RNA, 20 nt, Artificial Sequence
  targeting sequence with TTCN PAM
aaguaagcgccccugaggga

SEQ ID NO: 23929 - RNA, 20 nt, Artificial Sequence
  targeting sequence with TTCN PAM
aguagaggccgcagcacuca

SEQ ID NO: 23930 - RNA, 20 nt, Artificial Sequence
  targeting sequence with TTCN PAM
ccuccgguccccuguccuug

SEQ ID NO: 23931 - RNA, 20 nt, Artificial Sequence
  targeting sequence with TTCN PAM
uccuguggucucagccgaga

SEQ ID NO: 23932 - RNA, 20 nt, Artificial Sequence
  targeting sequence with TTCN PAM
uagaggagagggcaucucgg

SEQ ID NO: 23933 - RNA, 20 nt, Artificial Sequence
  targeting sequence with TTCN PAM
ccuguccuggacaccaacag

SEQ ID NO: 23934 - RNA, 20 nt, Artificial Sequence
  targeting sequence with TTCN PAM
ggguccugggcacguagccc

SEQ ID NO: 23935 - RNA, 20 nt, Artificial Sequence
  targeting sequence with TTCN PAM
uggaauuccucaccacagca

SEQ ID NO: 23936 - RNA, 20 nt, Artificial Sequence
  targeting sequence with TTCN PAM
aggaaggggcuacgugccca

SEQ ID NO: 23937 - RNA, 20 nt, Artificial Sequence
  targeting sequence with TTCN PAM
ucaccacagcaaaggguuuu

SEQ ID NO: 23938 - RNA, 20 nt, Artificial Sequence
  targeting sequence with TTCN PAM
cucugcuggcaccucccuga

SEQ ID NO: 23939 - RNA, 20 nt, Artificial Sequence
  targeting sequence with TTCN PAM
aaggggagaguuucaucuuu

SEQ ID NO: 23940 - RNA, 20 nt, Artificial Sequence
  targeting sequence with TTCN PAM
ucuuuauaaggaggcuccaa

SEQ ID NO: 23941 - RNA, 20 nt, Artificial Sequence
  targeting sequence with TTCN PAM
ugguggcugaugacaguccu

SEQ ID NO: 23942 - RNA, 20 nt, Artificial Sequence
  targeting sequence with TTCN PAM
ugcauguagcagcugccaug

SEQ ID NO: 23943 - RNA, 20 nt, Artificial Sequence
  targeting sequence with TTCN PAM
auggcaacugucauggcagc

SEQ ID NO: 23944 - RNA, 20 nt, Artificial Sequence
  targeting sequence with TTCN PAM
ccagcauuccauggcaacug

SEQ ID NO: 23945 - RNA, 20 nt, Artificial Sequence
  targeting sequence with TTCN PAM
cagccuaccccaagccgguc

SEQ ID NO: 23946 - RNA, 20 nt, Artificial Sequence
  targeting sequence with TTCN PAM
gugaucugucaccagguaac

SEQ ID NO: 23947 - RNA, 20 nt, Artificial Sequence
  targeting sequence with TTCN PAM
accagggugggacuuucugu

SEQ ID NO: 23948 - RNA, 20 nt, Artificial Sequence
  targeting sequence with TTCN PAM
cccugcuuagccgccugguc

SEQ ID NO: 23949 - RNA, 20 nt, Artificial Sequence
  targeting sequence with TTCN PAM
ccccucaacugccagcacac

SEQ ID NO: 23950 - RNA, 20 nt, Artificial Sequence
  targeting sequence with TTCN PAM
agucuuggugauggggagcc

SEQ ID NO: 23951 - RNA, 20 nt, Artificial Sequence
  targeting sequence with TTCN PAM
ugucccccaacccucagggc

SEQ ID NO: 23952 - RNA, 20 nt, Artificial Sequence
  targeting sequence with TTCN PAM
uuccugucccccaacccuca

SEQ ID NO: 23953 - RNA, 20 nt, Artificial Sequence
  targeting sequence with TTCN PAM
cugccgcucacagccuuggu

SEQ ID NO: 23954 - RNA, 20 nt, Artificial Sequence
  targeting sequence with TTCN PAM
caucuuuacagcaggacaau

SEQ ID NO: 23955 - RNA, 20 nt, Artificial Sequence
  targeting sequence with TTCN PAM
uccgcccuccuccagccgug

SEQ ID NO: 23956 - RNA, 20 nt, Artificial Sequence
  targeting sequence with TTCN PAM
gcugagcgucaaggggcgag

SEQ ID NO: 23957 - RNA, 20 nt, Artificial Sequence
  targeting sequence with TTCN PAM
ggguagugggggaggaggag

SEQ ID NO: 23958 - RNA, 20 nt, Artificial Sequence
  targeting sequence with TTCN PAM
cacagauugugccucuggac

SEQ ID NO: 23959 - RNA, 20 nt, Artificial Sequence
  targeting sequence with TTCN PAM
aggaucucaggaucucucaa

SEQ ID NO: 23960 - RNA, 20 nt, Artificial Sequence
  targeting sequence with TTCN PAM
ugccuucucccugccucuca

SEQ ID NO: 23961 - RNA, 20 nt, Artificial Sequence
  targeting sequence with TTCN PAM
cccugccucucacugccugu

SEQ ID NO: 23962 - RNA, 20 nt, Artificial Sequence
  targeting sequence with TTCN PAM
aaacaggggggcuccacagg

SEQ ID NO: 23963 - RNA, 20 nt, Artificial Sequence
  targeting sequence with TTCN PAM
gagucuuacggggggugggg

SEQ ID NO: 23964 - RNA, 20 nt, Artificial Sequence
  targeting sequence with TTCN PAM
gccccaccccguguccuucu

SEQ ID NO: 23965 - RNA, 20 nt, Artificial Sequence
  targeting sequence with TTCN PAM
ccaguuaguucccaagcaca

SEQ ID NO: 23966 - RNA, 20 nt, Artificial Sequence
  targeting sequence with TTCN PAM
caagcacaagaagaaaaucc

SEQ ID NO: 23967 - RNA, 20 nt, Artificial Sequence
  targeting sequence with TTCN PAM
ugugcuugggaacuaacugg

SEQ ID NO: 23968 - RNA, 20 nt, Artificial Sequence
  targeting sequence with TTCN PAM
ucuugugcuugggaacuaac

SEQ ID NO: 23969 - RNA, 20 nt, Artificial Sequence
  targeting sequence with TTCN PAM
ugggcuggauuuucuucuug

SEQ ID NO: 23970 - RNA, 20 nt, Artificial Sequence
  targeting sequence with TTCN PAM
ccuuggccucacccgcucuc

SEQ ID NO: 23971 - RNA, 20 nt, Artificial Sequence
  targeting sequence with TTCN PAM
uggggcccuuccccuuggcc

SEQ ID NO: 23972 - RNA, 20 nt, Artificial Sequence
  targeting sequence with TTCN PAM
ccuugcccacguugggaggg

SEQ ID NO: 23973 - RNA, 20 nt, Artificial Sequence
  targeting sequence with TTCN PAM
gcaccuuugcuggccucuug

SEQ ID NO: 23974 - RNA, 20 nt, Artificial Sequence
  targeting sequence with TTCN PAM
cuguggcugcgccuggcuug

SEQ ID NO: 23975 - RNA, 20 nt, Artificial Sequence
  targeting sequence with TTCN PAM
uagccucucccgacugugcc

SEQ ID NO: 23976 - RNA, 20 nt, Artificial Sequence
  targeting sequence with TTCN PAM
agugcuggugggcucagcag

SEQ ID NO: 23977 - RNA, 20 nt, Artificial Sequence
  targeting sequence with TTCN PAM
ugcugagcccaccagcacug

SEQ ID NO: 23978 - RNA, 20 nt, Artificial Sequence
  targeting sequence with TTCN PAM
uuaucuagugcauguguccu

SEQ ID NO: 23979 - RNA, 20 nt, Artificial Sequence
  targeting sequence with TTCN PAM
cucucuccaggucaagccca

SEQ ID NO: 23980 - RNA, 20 nt, Artificial Sequence
  targeting sequence with TTCN PAM
cccaaccagcuaccaugagu

SEQ ID NO: 23981 - RNA, 20 nt, Artificial Sequence
  targeting sequence with TTCN PAM
aggguuaugaagggggaagc

SEQ ID NO: 23982 - RNA, 20 nt, Artificial Sequence
  targeting sequence with TTCN PAM
uaacccuugaaaugucugcc

SEQ ID NO: 23983 - RNA, 20 nt, Artificial Sequence
  targeting sequence with TTCN PAM
cccuucauaacccuugaaau

SEQ ID NO: 23984 - RNA, 20 nt, Artificial Sequence
  targeting sequence with TTCN PAM
ugaggcaguggaggaaggug

SEQ ID NO: 23985 - RNA, 20 nt, Artificial Sequence
  targeting sequence with TTCN PAM
uccacugccucaagaaugag

SEQ ID NO: 23986 - RNA, 20 nt, Artificial Sequence
  targeting sequence with TTCN PAM
ccugcuugagacaccuuccu

SEQ ID NO: 23987 - RNA, 20 nt, Artificial Sequence
  targeting sequence with TTCN PAM
uuaugccuccaggccuuuac

SEQ ID NO: 23988 - RNA, 20 nt, Artificial Sequence
  targeting sequence with TTCN PAM
ccauguugaccagguugguc

SEQ ID NO: 23989 - RNA, 20 nt, Artificial Sequence
  targeting sequence with TTCN PAM
ugccucagccacccaaguac

SEQ ID NO: 23990 - RNA, 20 nt, Artificial Sequence
  targeting sequence with TTCN PAM
agugauuuuccugccucagc

SEQ ID NO: 23991 - RNA, 20 nt, Artificial Sequence
  targeting sequence with TTCN PAM
uuuuguguuuuguuuugaga

SEQ ID NO: 23992 - RNA, 20 nt, Artificial Sequence
  targeting sequence with TTCN PAM
ucaaauacuccaccuucuuu

SEQ ID NO: 23993 - RNA, 20 nt, Artificial Sequence
  targeting sequence with TTCN PAM
gucuaccuacaguuuuggca

SEQ ID NO: 23994 - RNA, 20 nt, Artificial Sequence
  targeting sequence with TTCN PAM
ccuugccaaaacuguaggua

SEQ ID NO: 23995 - RNA, 20 nt, Artificial Sequence
  targeting sequence with TTCN PAM
cagcuucuccuugccaaaac

SEQ ID NO: 23996 - RNA, 20 nt, Artificial Sequence
  targeting sequence with TTCN PAM
agcugcccuucacagcuucu

SEQ ID NO: 23997 - RNA, 20 nt, Artificial Sequence
  targeting sequence with TTCN PAM
acagcucugcauuguccucc

SEQ ID NO: 23998 - RNA, 20 nt, Artificial Sequence
  targeting sequence with TTCN PAM
gacaggaagcagcuagggcu

SEQ ID NO: 23999 - RNA, 20 nt, Artificial Sequence
  targeting sequence with TTCN PAM
ugucagaauccuuccacagc

SEQ ID NO: 24000 - RNA, 20 nt, Artificial Sequence
  targeting sequence with TTCN PAM
ucucucucuuuuagagacag

SEQ ID NO: 24001 - RNA, 20 nt, Artificial Sequence
  targeting sequence with TTCN PAM
ugggcucagcacucaccugu

SEQ ID NO: 24002 - RNA, 20 nt, Artificial Sequence
  targeting sequence with TTCN PAM
accuggcagccaggauacuu

SEQ ID NO: 24003 - RNA, 20 nt, Artificial Sequence
  targeting sequence with TTCN PAM
guuaacccuccagccacucu

SEQ ID NO: 24004 - RNA, 20 nt, Artificial Sequence
  targeting sequence with TTCN PAM
cagucuucaaacuaggucac

SEQ ID NO: 24005 - RNA, 20 nt, Artificial Sequence
  targeting sequence with TTCN PAM
aacuaggucacugaggcuca

SEQ ID NO: 24006 - RNA, 20 nt, Artificial Sequence
  targeting sequence with TTCN PAM
cucaguuaugugacaugggg

SEQ ID NO: 24007 - RNA, 20 nt, Artificial Sequence
  targeting sequence with TTCN PAM
uccuggguccuaggucuuca

SEQ ID NO: 24008 - RNA, 20 nt, Artificial Sequence
  targeting sequence with TTCN PAM
agagccccugaaacuuccug

SEQ ID NO: 24009 - RNA, 20 nt, Artificial Sequence
  targeting sequence with TTCN PAM
ggggcucuagaacccccauu

SEQ ID NO: 24010 - RNA, 20 nt, Artificial Sequence
  targeting sequence with TTCN PAM
ugccccaccagcaguuccuc

SEQ ID NO: 24011 - RNA, 20 nt, Artificial Sequence
  targeting sequence with TTCN PAM
uccuucuuccccuauaaaac

SEQ ID NO: 24012 - RNA, 20 nt, Artificial Sequence
  targeting sequence with TTCN PAM
uccccuauaaaaccuccucc

SEQ ID NO: 24013 - RNA, 20 nt, Artificial Sequence
  targeting sequence with TTCN PAM
ccuauaaaaccuccuccauc

SEQ ID NO: 24014 - RNA, 20 nt, Artificial Sequence
  targeting sequence with TTCN PAM
aggagaugcugaggccuaca

SEQ ID NO: 24015 - RNA, 20 nt, Artificial Sequence
  targeting sequence with TTCN PAM
uguaggccucagcaucuccu

SEQ ID NO: 24016 - RNA, 20 nt, Artificial Sequence
  targeting sequence with TTCN PAM
aaacccacggccagcaaggu

SEQ ID NO: 24017 - RNA, 20 nt, Artificial Sequence
  targeting sequence with TTCN PAM
ugcaggcaccuaccuugcug

SEQ ID NO: 24018 - RNA, 20 nt, Artificial Sequence
  targeting sequence with TTCN PAM
uggccuggcugccugcccug

SEQ ID NO: 24019 - RNA, 20 nt, Artificial Sequence
  targeting sequence with TTCN PAM
gggcaggcagccaggccagg

SEQ ID NO: 24020 - RNA, 20 nt, Artificial Sequence
  targeting sequence with TTCN PAM
gggggcugagugugggaugc

SEQ ID NO: 24021 - RNA, 20 nt, Artificial Sequence
  targeting sequence with TTCN PAM
uuuccuacaaagcacagucc

SEQ ID NO: 24022 - RNA, 20 nt, Artificial Sequence
  targeting sequence with TTCN PAM
uacaaagcacaguccaccac

SEQ ID NO: 24023 - RNA, 20 nt, Artificial Sequence
  targeting sequence with TTCN PAM
cucugguccccuggcacccu

SEQ ID NO: 24024 - RNA, 20 nt, Artificial Sequence
  targeting sequence with TTCN PAM
aagccuuagucucuuaucug

SEQ ID NO: 24025 - RNA, 20 nt, Artificial Sequence
  targeting sequence with TTCN PAM
gcccuucccagcugucucuu

SEQ ID NO: 24026 - RNA, 20 nt, Artificial Sequence
  targeting sequence with TTCN PAM
cagcugucucuuugcuccug

SEQ ID NO: 24027 - RNA, 20 nt, Artificial Sequence
  targeting sequence with TTCN PAM
uauaggucaagaauggugcu

SEQ ID NO: 24028 - RNA, 20 nt, Artificial Sequence
  targeting sequence with TTCN PAM
ugaccuauacgaaagcaaac

SEQ ID NO: 24029 - RNA, 20 nt, Artificial Sequence
  targeting sequence with TTCN PAM
ccgaccaaaaagaagguggu

SEQ ID NO: 24030 - RNA, 20 nt, Artificial Sequence
  targeting sequence with TTCN PAM
uuuuggucggggaagcagca

SEQ ID NO: 24031 - RNA, 20 nt, Artificial Sequence
  targeting sequence with TTCN PAM
uggacaaaugugcagguacc

SEQ ID NO: 24032 - RNA, 20 nt, Artificial Sequence
  targeting sequence with TTCN PAM
agggcccuugggggccucug

SEQ ID NO: 24033 - RNA, 20 nt, Artificial Sequence
  targeting sequence with TTCN PAM
gcccucuggcuggacacuuu

SEQ ID NO: 24034 - RNA, 20 nt, Artificial Sequence
  targeting sequence with TTCN PAM
ucaacuaaccacugcucuau

SEQ ID NO: 24035 - RNA, 20 nt, Artificial Sequence
  targeting sequence with TTCN PAM
acuaaccacugcucuauuua

SEQ ID NO: 24036 - RNA, 20 nt, Artificial Sequence
  targeting sequence with TTCN PAM
uuguaagcuauuuaucaaua

SEQ ID NO: 24037 - RNA, 20 nt, Artificial Sequence
  targeting sequence with TTCN PAM
uuuuccucacaauuggugug

SEQ ID NO: 24038 - RNA, 20 nt, Artificial Sequence
  targeting sequence with TTCN PAM
ucacaauugguguggguaga

SEQ ID NO: 24039 - RNA, 20 nt, Artificial Sequence
  targeting sequence with TTCN PAM
aggauuuggccauucggucc

SEQ ID NO: 24040 - RNA, 20 nt, Artificial Sequence
  targeting sequence with TTCN PAM
guccuucaugaacauccgcu

SEQ ID NO: 24041 - RNA, 20 nt, Artificial Sequence
  targeting sequence with TTCN PAM
ugaacauccgcugagcaccu

SEQ ID NO: 24042 - RNA, 20 nt, Artificial Sequence
  targeting sequence with TTCN PAM
ugaaggaccgaauggccaaa

SEQ ID NO: 24043 - RNA, 20 nt, Artificial Sequence
  targeting sequence with TTCN PAM
aggaugagauggcuuuugau

SEQ ID NO: 24044 - RNA, 20 nt, Artificial Sequence
  targeting sequence with TTCN PAM
ucccaccccucagauggcau

SEQ ID NO: 24045 - RNA, 20 nt, Artificial Sequence
  targeting sequence with TTCN PAM
aaacagauccccuccuuuca

SEQ ID NO: 24046 - RNA, 20 nt, Artificial Sequence
  targeting sequence with TTCN PAM
uucuaaacagauccccuccu

SEQ ID NO: 24047 - RNA, 20 nt, Artificial Sequence
  targeting sequence with TTCN PAM
acugccagaggguucuuucu

SEQ ID NO: 24048 - RNA, 20 nt, Artificial Sequence
  targeting sequence with TTCN PAM
uuuccacugccagaggguuc

SEQ ID NO: 24049 - RNA, 20 nt, Artificial Sequence
  targeting sequence with TTCN PAM
cagcuacucuaauccuuccu

SEQ ID NO: 24050 - RNA, 20 nt, Artificial Sequence
  targeting sequence with TTCN PAM
gccacugguucccgagugcu

SEQ ID NO: 24051 - RNA, 20 nt, Artificial Sequence
  targeting sequence with TTCN PAM
cgagugcuccugggccaggc

SEQ ID NO: 24052 - RNA, 20 nt, Artificial Sequence
  targeting sequence with TTCN PAM
gagcacaggcgcuggcugca

SEQ ID NO: 24053 - RNA, 20 nt, Artificial Sequence
  targeting sequence with TTCN PAM
ucagagcacaggcgcuggcu

SEQ ID NO: 24054 - RNA, 20 nt, Artificial Sequence
  targeting sequence with TTCN PAM
gcagaaggaagagugaaugc

SEQ ID NO: 24055 - RNA, 20 nt, Artificial Sequence
  targeting sequence with TTCN PAM
gcugaaaugguacccccucc

SEQ ID NO: 24056 - RNA, 20 nt, Artificial Sequence
  targeting sequence with TTCN PAM
uucugcugaaaugguacccc

SEQ ID NO: 24057 - RNA, 20 nt, Artificial Sequence
  targeting sequence with TTCN PAM
cucuuccuucugcugaaaug

SEQ ID NO: 24058 - RNA, 20 nt, Artificial Sequence
  targeting sequence with TTCN PAM
caccccagggccuuugcauu

SEQ ID NO: 24059 - RNA, 20 nt, Artificial Sequence
  targeting sequence with TTCN PAM
ugcagcucccagcgugagga

SEQ ID NO: 24060 - RNA, 20 nt, Artificial Sequence
  targeting sequence with TTCN PAM
acuggucaaguaaucaugga

SEQ ID NO: 24061 - RNA, 20 nt, Artificial Sequence
  targeting sequence with TTCN PAM
gggccccaccuuaaggcagc

SEQ ID NO: 24062 - RNA, 20 nt, Artificial Sequence
  targeting sequence with TTCN PAM
acuucuuguguuugaggaca

SEQ ID NO: 24063 - RNA, 20 nt, Artificial Sequence
  targeting sequence with TTCN PAM
uguguuugaggacacuuuuu

SEQ ID NO: 24064 - RNA, 20 nt, Artificial Sequence
  targeting sequence with TTCN PAM
aacuuggccaccacucuaug

SEQ ID NO: 24065 - RNA, 20 nt, Artificial Sequence
  targeting sequence with TTCN PAM
cauagagugguggccaaguu

SEQ ID NO: 24066 - RNA, 20 nt, Artificial Sequence
  targeting sequence with TTCN PAM
ucuccacaagcugcaugggc

SEQ ID NO: 24067 - RNA, 20 nt, Artificial Sequence
  targeting sequence with TTCN PAM
gcuccugcugaacucucuga

SEQ ID NO: 24068 - RNA, 20 nt, Artificial Sequence
  targeting sequence with TTCN PAM
gcaggagcugaaaaauggag

SEQ ID NO: 24069 - RNA, 20 nt, Artificial Sequence
  targeting sequence with TTCN PAM
gaugguggcacgugguacca

SEQ ID NO: 24070 - RNA, 20 nt, Artificial Sequence
  targeting sequence with TTCN PAM
aacacgcauucagauggugg

SEQ ID NO: 24071 - RNA, 20 nt, Artificial Sequence
  targeting sequence with TTCN PAM
agcccuaauugagcuggccc

SEQ ID NO: 24072 - RNA, 20 nt, Artificial Sequence
  targeting sequence with TTCN PAM
gcugggccagcucaauuagg

SEQ ID NO: 24073 - RNA, 20 nt, Artificial Sequence
  targeting sequence with TTCN PAM
accagguuucugcugggcca

SEQ ID NO: 24074 - RNA, 20 nt, Artificial Sequence
  targeting sequence with TTCN PAM
ugccaagcccugcccugauu

SEQ ID NO: 24075 - RNA, 20 nt, Artificial Sequence
  targeting sequence with TTCN PAM
ugggcaaaauaagugacugc

SEQ ID NO: 24076 - RNA, 20 nt, Artificial Sequence
  targeting sequence with TTCN PAM
aaacagauccccuuccuuuc

SEQ ID NO: 24077 - RNA, 20 nt, Artificial Sequence
  targeting sequence with TTCN PAM
uuucacuggaacaagggcug

SEQ ID NO: 24078 - RNA, 20 nt, Artificial Sequence
  targeting sequence with TTCN PAM
cuggaacaagggcugcaggg

SEQ ID NO: 24079 - RNA, 20 nt, Artificial Sequence
  targeting sequence with TTCN PAM
agugaaaggaaggggaucug

SEQ ID NO: 24080 - RNA, 20 nt, Artificial Sequence
  targeting sequence with TTCN PAM
uuaugacaaagcccaccgug

SEQ ID NO: 24081 - RNA, 20 nt, Artificial Sequence
  targeting sequence with TTCN PAM
ucuggguuguggcaggagcc

SEQ ID NO: 24082 - RNA, 20 nt, Artificial Sequence
  targeting sequence with TTCN PAM
aacccucccucugugagcau

SEQ ID NO: 24083 - RNA, 20 nt, Artificial Sequence
  targeting sequence with TTCN PAM
ggaucgcuguugaagauggu

SEQ ID NO: 24084 - RNA, 20 nt, Artificial Sequence
  targeting sequence with TTCN PAM
acagcgauccagaagcuacc

SEQ ID NO: 24085 - RNA, 20 nt, Artificial Sequence
  targeting sequence with TTCN PAM
caccaucuucaacagcgauc

SEQ ID NO: 24086 - RNA, 20 nt, Artificial Sequence
  targeting sequence with TTCN PAM
uacauccaauccaucagcag

SEQ ID NO: 24087 - RNA, 20 nt, Artificial Sequence
  targeting sequence with TTCN PAM
ugaggugaggacuuggcacg

SEQ ID NO: 24088 - RNA, 20 nt, Artificial Sequence
  targeting sequence with TTCN PAM
cucuguccuccguggcuagg

SEQ ID NO: 24089 - RNA, 20 nt, Artificial Sequence
  targeting sequence with TTCN PAM
uucucucuguccuccguggc

SEQ ID NO: 24090 - RNA, 20 nt, Artificial Sequence
  targeting sequence with TTCN PAM
caaguccugugcaguuugcc

SEQ ID NO: 24091 - RNA, 20 nt, Artificial Sequence
  targeting sequence with TTCN PAM
cuuugugccccgucugcccc

SEQ ID NO: 24092 - RNA, 20 nt, Artificial Sequence
  targeting sequence with TTCN PAM
ugccccugcuccaccacccc

SEQ ID NO: 24093 - RNA, 20 nt, Artificial Sequence
  targeting sequence with TTCN PAM
aggaggagaggguggggugg

SEQ ID NO: 24094 - RNA, 20 nt, Artificial Sequence
  targeting sequence with TTCN PAM
ggguccugcuggcagccaca

SEQ ID NO: 24095 - RNA, 20 nt, Artificial Sequence
  targeting sequence with TTCN PAM
ugaggaggggucugcuccug

SEQ ID NO: 24096 - RNA, 20 nt, Artificial Sequence
  targeting sequence with TTCN PAM
cggcuuggcccagugcugug

SEQ ID NO: 24097 - RNA, 20 nt, Artificial Sequence
  targeting sequence with TTCN PAM
uggaugcuagacacccccca

SEQ ID NO: 24098 - RNA, 20 nt, Artificial Sequence
  targeting sequence with TTCN PAM
uuccuuuucaaaggaguuua

SEQ ID NO: 24099 - RNA, 20 nt, Artificial Sequence
  targeting sequence with TTCN PAM
uuuucaaaggaguuuaguuu

SEQ ID NO: 24100 - RNA, 20 nt, Artificial Sequence
  targeting sequence with TTCN PAM
aaggaguuuaguuuaaggau

SEQ ID NO: 24101 - RNA, 20 nt, Artificial Sequence
  targeting sequence with TTCN PAM
uacccuuugagggucauagg

SEQ ID NO: 24102 - RNA, 20 nt, Artificial Sequence
  targeting sequence with TTCN PAM
uggaagguggccaccuucug

SEQ ID NO: 24103 - RNA, 20 nt, Artificial Sequence
  targeting sequence with TTCN PAM
augaaccaauuauaauccuu

SEQ ID NO: 24104 - RNA, 20 nt, Artificial Sequence
  targeting sequence with TTCN PAM
gcgcugagaaacgacucugg

SEQ ID NO: 24105 - RNA, 20 nt, Artificial Sequence
  targeting sequence with TTCN PAM
cagcgcagaagguggccacc

SEQ ID NO: 24106 - RNA, 20 nt, Artificial Sequence
  targeting sequence with TTCN PAM
agagucguuucucagcgcag

SEQ ID NO: 24107 - RNA, 20 nt, Artificial Sequence
  targeting sequence with TTCN PAM
uccauuugcaaauacauuuc

SEQ ID NO: 24108 - RNA, 20 nt, Artificial Sequence
  targeting sequence with TTCN PAM
aaacgucaaggaggaacuga

SEQ ID NO: 24109 - RNA, 20 nt, Artificial Sequence
  targeting sequence with TTCN PAM
uccuugacguuuagaaaugu

SEQ ID NO: 24110 - RNA, 20 nt, Artificial Sequence
  targeting sequence with TTCN PAM
guuccuccuugacguuuaga

SEQ ID NO: 24111 - RNA, 20 nt, Artificial Sequence
  targeting sequence with TTCN PAM
acagccugucuuaaugucug

SEQ ID NO: 24112 - RNA, 20 nt, Artificial Sequence
  targeting sequence with TTCN PAM
augucauuaaauauuccaca

SEQ ID NO: 24113 - RNA, 20 nt, Artificial Sequence
  targeting sequence with TTCN PAM
cccaugcgacaauaugucag

SEQ ID NO: 24114 - RNA, 20 nt, Artificial Sequence
  targeting sequence with TTCN PAM
cuccucggccccgccccauc

SEQ ID NO: 24115 - RNA, 20 nt, Artificial Sequence
  targeting sequence with TTCN PAM
cagagacgcucgccacaaac

SEQ ID NO: 24116 - RNA, 20 nt, Artificial Sequence
  targeting sequence with TTCN PAM
ucacgcuuuuugugcuuccu

SEQ ID NO: 24117 - RNA, 20 nt, Artificial Sequence
  targeting sequence with TTCN PAM
cgcuuuuugugcuuccuaca

SEQ ID NO: 24118 - RNA, 20 nt, Artificial Sequence
  targeting sequence with TTCN PAM
uacauuucucugggaaccgu

SEQ ID NO: 24119 - RNA, 20 nt, Artificial Sequence
  targeting sequence with TTCN PAM
cugggaaccguguauucauu

SEQ ID NO: 24120 - RNA, 20 nt, Artificial Sequence
  targeting sequence with TTCN PAM
cagagaaauguaggaagcac

SEQ ID NO: 24121 - RNA, 20 nt, Artificial Sequence
  targeting sequence with TTCN PAM
uuccagaaucacacccaccc

SEQ ID NO: 24122 - RNA, 20 nt, Artificial Sequence
  targeting sequence with TTCN PAM
agaaucacacccaccccccu

SEQ ID NO: 24123 - RNA, 20 nt, Artificial Sequence
  targeting sequence with TTCN PAM
ggaaugaauacacgguuccc

SEQ ID NO: 24124 - RNA, 20 nt, Artificial Sequence
  targeting sequence with TTCN PAM
aauuuaaguuaucagcacau

SEQ ID NO: 24125 - RNA, 20 nt, Artificial Sequence
  targeting sequence with TTCN PAM
uauuaagcagcagauuuucu

SEQ ID NO: 24126 - RNA, 20 nt, Artificial Sequence
  targeting sequence with TTCN PAM
uucuuauuaagcagcagauu

SEQ ID NO: 24127 - RNA, 20 nt, Artificial Sequence
  targeting sequence with TTCN PAM
gagcauugauuccuucuuau

SEQ ID NO: 24128 - RNA, 20 nt, Artificial Sequence
  targeting sequence with TTCN PAM
auucugagcauugauuccuu

SEQ ID NO: 24129 - RNA, 20 nt, Artificial Sequence
  targeting sequence with TTCN PAM
cauuuucuauucugagcauu

SEQ ID NO: 24130 - RNA, 20 nt, Artificial Sequence
  targeting sequence with TTCN PAM
guguggagagauagucuuua

SEQ ID NO: 24131 - RNA, 20 nt, Artificial Sequence
  targeting sequence with TTCN PAM
uacaguggcuucugugugga

SEQ ID NO: 24132 - RNA, 20 nt, Artificial Sequence
  targeting sequence with TTCN PAM
cacuuuucuguucucauuaa

SEQ ID NO: 24133 - RNA, 20 nt, Artificial Sequence
  targeting sequence with TTCN PAM
guucucauuaauuuuagaac

SEQ ID NO: 24134 - RNA, 20 nt, Artificial Sequence
  targeting sequence with TTCN PAM
cauuaauuuuagaacuggua

SEQ ID NO: 24135 - RNA, 20 nt, Artificial Sequence
  targeting sequence with TTCN PAM
aaaauuaaugagaacagaaa

SEQ ID NO: 24136 - RNA, 20 nt, Artificial Sequence
  targeting sequence with TTCN PAM
uaaaauuuaaacaaaauccc

SEQ ID NO: 24137 - RNA, 20 nt, Artificial Sequence
  targeting sequence with TTCN PAM
uacucuugauaaauacaugu

SEQ ID NO: 24138 - RNA, 20 nt, Artificial Sequence
  targeting sequence with TTCN PAM
uucaaaaaagcaagaaauua

SEQ ID NO: 24139 - RNA, 20 nt, Artificial Sequence
  targeting sequence with TTCN PAM
aaaaagcaagaaauuaagug

SEQ ID NO: 24140 - RNA, 20 nt, Artificial Sequence
  targeting sequence with TTCN PAM
ugcuuuuuugaaggaaaaau

SEQ ID NO: 24141 - RNA, 20 nt, Artificial Sequence
  targeting sequence with TTCN PAM
cugggguuggagaggagcca

SEQ ID NO: 24142 - RNA, 20 nt, Artificial Sequence
  targeting sequence with TTCN PAM
agcccugcuggcuccucucc

SEQ ID NO: 24143 - RNA, 20 nt, Artificial Sequence
  targeting sequence with TTCN PAM
uuguucuugugggcaggggu

SEQ ID NO: 24144 - RNA, 20 nt, Artificial Sequence
  targeting sequence with TTCN PAM
ugugggcaggggugaggaac

SEQ ID NO: 24145 - RNA, 20 nt, Artificial Sequence
  targeting sequence with TTCN PAM
ucaccccugcccacaagaac

SEQ ID NO: 24146 - RNA, 20 nt, Artificial Sequence
  targeting sequence with TTCN PAM
ccacaaguacaggcuguucc

SEQ ID NO: 24147 - RNA, 20 nt, Artificial Sequence
  targeting sequence with TTCN PAM
uugucugagaaaugagcuua

SEQ ID NO: 24148 - RNA, 20 nt, Artificial Sequence
  targeting sequence with TTCN PAM
cagacaaggaagcaggcagu

SEQ ID NO: 24149 - RNA, 20 nt, Artificial Sequence
  targeting sequence with TTCN PAM
caucaagcuuaaaaaauacg

SEQ ID NO: 24150 - RNA, 20 nt, Artificial Sequence
  targeting sequence with TTCN PAM
ggguaaguuaagugucaguu

SEQ ID NO: 24151 - RNA, 20 nt, Artificial Sequence
  targeting sequence with TTCN PAM
cuuuccaggguggucaccuu

SEQ ID NO: 24152 - RNA, 20 nt, Artificial Sequence
  targeting sequence with TTCN PAM
aggguggucaccuuuggccu

SEQ ID NO: 24153 - RNA, 20 nt, Artificial Sequence
  targeting sequence with TTCN PAM
gggccagagucuccacagug

SEQ ID NO: 24154 - RNA, 20 nt, Artificial Sequence
  targeting sequence with TTCN PAM
gucccuuccugguuguguga

SEQ ID NO: 24155 - RNA, 20 nt, Artificial Sequence
  targeting sequence with TTCN PAM
ugguugugugaccuugagaa

SEQ ID NO: 24156 - RNA, 20 nt, Artificial Sequence
  targeting sequence with TTCN PAM
caaggucacacaaccaggaa

SEQ ID NO: 24157 - RNA, 20 nt, Artificial Sequence
  targeting sequence with TTCN PAM
gcugugcugagccucaaguu

SEQ ID NO: 24158 - RNA, 20 nt, Artificial Sequence
  targeting sequence with TTCN PAM
ugacgggcuuguuagagaug

SEQ ID NO: 24159 - RNA, 20 nt, Artificial Sequence
  targeting sequence with TTCN PAM
cagcugcugugugcugccug

SEQ ID NO: 24160 - RNA, 20 nt, Artificial Sequence
  targeting sequence with TTCN PAM
uggaggucccgggguguccu

SEQ ID NO: 24161 - RNA, 20 nt, Artificial Sequence
  targeting sequence with TTCN PAM
uuaagcucugaggacacccc

SEQ ID NO: 24162 - RNA, 20 nt, Artificial Sequence
  targeting sequence with TTCN PAM
ucuccuggccucugacugcc

SEQ ID NO: 24163 - RNA, 20 nt, Artificial Sequence
  targeting sequence with TTCN PAM
cagaagcuagucaggugucu

SEQ ID NO: 24164 - RNA, 20 nt, Artificial Sequence
  targeting sequence with TTCN PAM
gagaaggcagucagaggcca

SEQ ID NO: 24165 - RNA, 20 nt, Artificial Sequence
  targeting sequence with TTCN PAM
uuaccaguuugugagagaga

SEQ ID NO: 24166 - RNA, 20 nt, Artificial Sequence
  targeting sequence with TTCN PAM
cccgcuuggcuaucucagga

SEQ ID NO: 24167 - RNA, 20 nt, Artificial Sequence
  targeting sequence with TTCN PAM
uuauaauaaaagccuuacgg

SEQ ID NO: 24168 - RNA, 20 nt, Artificial Sequence
  targeting sequence with TTCN PAM
agagucccagcugccccccu

SEQ ID NO: 24169 - RNA, 20 nt, Artificial Sequence
  targeting sequence with TTCN PAM
ggcaggaacggagugggugg

SEQ ID NO: 24170 - RNA, 20 nt, Artificial Sequence
  targeting sequence with TTCN PAM
ugccagaaacgacccucugu

SEQ ID NO: 24171 - RNA, 20 nt, Artificial Sequence
  targeting sequence with TTCN PAM
agagagcgggcagaccuggc

SEQ ID NO: 24172 - RNA, 20 nt, Artificial Sequence
  targeting sequence with TTCN PAM
aguguugcauggggagccuc

SEQ ID NO: 24173 - RNA, 20 nt, Artificial Sequence
  targeting sequence with TTCN PAM
caguuggugcaugauacguu

SEQ ID NO: 24174 - RNA, 20 nt, Artificial Sequence
  targeting sequence with TTCN PAM
aaagauagcaccacuuuuuu

SEQ ID NO: 24175 - RNA, 20 nt, Artificial Sequence
  targeting sequence with TTCN PAM
gcaagaucaaguagcccagc

SEQ ID NO: 24176 - RNA, 20 nt, Artificial Sequence
  targeting sequence with TTCN PAM
uggagacggggcucccagcu

SEQ ID NO: 24177 - RNA, 20 nt, Artificial Sequence
  targeting sequence with TTCN PAM
aggagggcucccugcaccag

SEQ ID NO: 24178 - RNA, 20 nt, Artificial Sequence
  targeting sequence with TTCN PAM
gggcugcagccuccgggcug

SEQ ID NO: 24179 - RNA, 20 nt, Artificial Sequence
  targeting sequence with TTCN PAM
ugggagagaacacaccccug

SEQ ID NO: 24180 - RNA, 20 nt, Artificial Sequence
  targeting sequence with TTCN PAM
cucccacgaacugaggcagg

SEQ ID NO: 24181 - RNA, 20 nt, Artificial Sequence
  targeting sequence with TTCN PAM
gggguguguucucucccacg

SEQ ID NO: 24182 - RNA, 20 nt, Artificial Sequence
  targeting sequence with TTCN PAM
uacucaaggacacacaucuc

SEQ ID NO: 24183 - RNA, 20 nt, Artificial Sequence
  targeting sequence with TTCN PAM
acaccaauguggccauggca

SEQ ID NO: 24184 - RNA, 20 nt, Artificial Sequence
  targeting sequence with TTCN PAM
gguauuucuauaaggaggca

SEQ ID NO: 24185 - RNA, 20 nt, Artificial Sequence
  targeting sequence with TTCN PAM
auaaggaggcaggaugggga

SEQ ID NO: 24186 - RNA, 20 nt, Artificial Sequence
  targeting sequence with TTCN PAM
gugggggccguggggaguug

SEQ ID NO: 24187 - RNA, 20 nt, Artificial Sequence
  targeting sequence with TTCN PAM
gcgaugaggccccucaaguc

SEQ ID NO: 24188 - RNA, 20 nt, Artificial Sequence
  targeting sequence with TTCN PAM
uccaugggacuugaggggcc

SEQ ID NO: 24189 - RNA, 20 nt, Artificial Sequence
  targeting sequence with TTCN PAM
cggacccugaaguccaaucu

SEQ ID NO: 24190 - RNA, 20 nt, Artificial Sequence
  targeting sequence with TTCN PAM
ggguccgggaagccgucuuc

SEQ ID NO: 24191 - RNA, 20 nt, Artificial Sequence
  targeting sequence with TTCN PAM
cagaguuugaggagcggggg

SEQ ID NO: 24192 - RNA, 20 nt, Artificial Sequence
  targeting sequence with TTCN PAM
ucaugcauuuucccagaguu

SEQ ID NO: 24193 - RNA, 20 nt, Artificial Sequence
  targeting sequence with TTCN PAM
gaaaugcccucugcgcuccc

SEQ ID NO: 24194 - RNA, 20 nt, Artificial Sequence
  targeting sequence with TTCN PAM
gaaguggcuguggccucuug

SEQ ID NO: 24195 - RNA, 20 nt, Artificial Sequence
  targeting sequence with TTCN PAM
ggcccccaucccccgccgcc

SEQ ID NO: 24196 - RNA, 20 nt, Artificial Sequence
  targeting sequence with TTCN PAM
ucucuugcucgcugagcggc

SEQ ID NO: 24197 - RNA, 20 nt, Artificial Sequence
  targeting sequence with TTCN PAM
gguacucaggaaucuccuug

SEQ ID NO: 24198 - RNA, 20 nt, Artificial Sequence
  targeting sequence with TTCN PAM
ugaguaccggaagaucgugc

SEQ ID NO: 24199 - RNA, 20 nt, Artificial Sequence
  targeting sequence with TTCN PAM
ccaaccaacaagcuccucua

SEQ ID NO: 24200 - RNA, 20 nt, Artificial Sequence
  targeting sequence with TTCN PAM
cugcccaggauucgccaacc

SEQ ID NO: 24201 - RNA, 20 nt, Artificial Sequence
  targeting sequence with TTCN PAM
ccagcagccaucuaacaccc

SEQ ID NO: 24202 - RNA, 20 nt, Artificial Sequence
  targeting sequence with TTCN PAM
ggaugagcccucaucccucc

SEQ ID NO: 24203 - RNA, 20 nt, Artificial Sequence
  targeting sequence with TTCN PAM
gugaccgggugagacucuuu

SEQ ID NO: 24204 - RNA, 20 nt, Artificial Sequence
  targeting sequence with TTCN PAM
ccaggacuguuaggacaaug

SEQ ID NO: 24205 - RNA, 20 nt, Artificial Sequence
  targeting sequence with TTCN PAM
uucaggggaaaagugcacgg

SEQ ID NO: 24206 - RNA, 20 nt, Artificial Sequence
  targeting sequence with TTCN PAM
ggggaaaagugcacgggcau

SEQ ID NO: 24207 - RNA, 20 nt, Artificial Sequence
  targeting sequence with TTCN PAM
ccugaaagaaguagggcccc

SEQ ID NO: 24208 - RNA, 20 nt, Artificial Sequence
  targeting sequence with TTCN PAM
cugcacgcagcccauuccac

SEQ ID NO: 24209 - RNA, 20 nt, Artificial Sequence
  targeting sequence with TTCN PAM
acguaacaaggauguguccu

SEQ ID NO: 24210 - RNA, 20 nt, Artificial Sequence
  targeting sequence with TTCN PAM
cagggugauaggucuuggug

SEQ ID NO: 24211 - RNA, 20 nt, Artificial Sequence
  targeting sequence with TTCN PAM
uggaagccugagugcuggcu

SEQ ID NO: 24212 - RNA, 20 nt, Artificial Sequence
  targeting sequence with TTCN PAM
aggaauccuagccaccaaga

SEQ ID NO: 24213 - RNA, 20 nt, Artificial Sequence
  targeting sequence with TTCN PAM
acugagccagcacucaggcu

SEQ ID NO: 24214 - RNA, 20 nt, Artificial Sequence
  targeting sequence with TTCN PAM
caccacaugcuccuaacgcc

SEQ ID NO: 24215 - RNA, 20 nt, Artificial Sequence
  targeting sequence with TTCN PAM
ggcguuaggagcauguggug

SEQ ID NO: 24216 - RNA, 20 nt, Artificial Sequence
  targeting sequence with TTCN PAM
uucaggcguuaggagcaugu

SEQ ID NO: 24217 - RNA, 20 nt, Artificial Sequence
  targeting sequence with TTCN PAM
uggcacuucuuucaggcguu

SEQ ID NO: 24218 - RNA, 20 nt, Artificial Sequence
  targeting sequence with TTCN PAM
uugucagucacgggcacccu

SEQ ID NO: 24219 - RNA, 20 nt, Artificial Sequence
  targeting sequence with TTCN PAM
gaggcaguacgugaguagua

SEQ ID NO: 24220 - RNA, 20 nt, Artificial Sequence
  targeting sequence with TTCN PAM
ccuucccgugguccgucucu

SEQ ID NO: 24221 - RNA, 20 nt, Artificial Sequence
  targeting sequence with TTCN PAM
cgugguccgucucugaaaug

SEQ ID NO: 24222 - RNA, 20 nt, Artificial Sequence
  targeting sequence with TTCN PAM
gagacggaccacgggaagga

SEQ ID NO: 24223 - RNA, 20 nt, Artificial Sequence
  targeting sequence with TTCN PAM
ugccucccugucuuugccug

SEQ ID NO: 24224 - RNA, 20 nt, Artificial Sequence
  targeting sequence with TTCN PAM
cucugccuggaaggccaucc

SEQ ID NO: 24225 - RNA, 20 nt, Artificial Sequence
  targeting sequence with TTCN PAM
aggcagagagaacggcgcag

SEQ ID NO: 24226 - RNA, 20 nt, Artificial Sequence
  targeting sequence with TTCN PAM
ucuucaaccucuaaagccag

SEQ ID NO: 24227 - RNA, 20 nt, Artificial Sequence
  targeting sequence with TTCN PAM
accucuaaagccagacacag

SEQ ID NO: 24228 - RNA, 20 nt, Artificial Sequence
  targeting sequence with TTCN PAM
ugcgguguguugggggcaca

SEQ ID NO: 24229 - RNA, 20 nt, Artificial Sequence
  targeting sequence with TTCN PAM
cugaaugcucgcuugaaugg

SEQ ID NO: 24230 - RNA, 20 nt, Artificial Sequence
  targeting sequence with TTCN PAM
gugaaggggugggcagaggg

SEQ ID NO: 24231 - RNA, 20 nt, Artificial Sequence
  targeting sequence with TTCN PAM
agcgagcauucagugaaggg

SEQ ID NO: 24232 - RNA, 20 nt, Artificial Sequence
  targeting sequence with TTCN PAM
ggggcuacugcccagagccu

SEQ ID NO: 24233 - RNA, 20 nt, Artificial Sequence
  targeting sequence with TTCN PAM
gaugauguugugccugacca

SEQ ID NO: 24234 - RNA, 20 nt, Artificial Sequence
  targeting sequence with TTCN PAM
cacaccggguucucaggccu

SEQ ID NO: 24235 - RNA, 20 nt, Artificial Sequence
  targeting sequence with TTCN PAM
caggccuguguucaaagcca

SEQ ID NO: 24236 - RNA, 20 nt, Artificial Sequence
  targeting sequence with TTCN PAM
aagccagugccaggcacagc

SEQ ID NO: 24237 - RNA, 20 nt, Artificial Sequence
  targeting sequence with TTCN PAM
gauggaagguacuggcuucu

SEQ ID NO: 24238 - RNA, 20 nt, Artificial Sequence
  targeting sequence with TTCN PAM
aucagaaacucuguaucgcu

SEQ ID NO: 24239 - RNA, 20 nt, Artificial Sequence
  targeting sequence with TTCN PAM
aggugucucccugucugaau

SEQ ID NO: 24240 - RNA, 20 nt, Artificial Sequence
  targeting sequence with TTCN PAM
gacagggagacaccuagaag

SEQ ID NO: 24241 - RNA, 20 nt, Artificial Sequence
  targeting sequence with TTCN PAM
ccucccaggaagaucucuga

SEQ ID NO: 24242 - RNA, 20 nt, Artificial Sequence
  targeting sequence with TTCN PAM
ugggaggggaaccaaaagau

SEQ ID NO: 24243 - RNA, 20 nt, Artificial Sequence
  targeting sequence with TTCN PAM
caggaccaggccaggcccau

SEQ ID NO: 24244 - RNA, 20 nt, Artificial Sequence
  targeting sequence with TTCN PAM
ucgacgccugcuccaucucu

SEQ ID NO: 24245 - RNA, 20 nt, Artificial Sequence
  targeting sequence with TTCN PAM
gucaucgcgcaggccuucau

SEQ ID NO: 24246 - RNA, 20 nt, Artificial Sequence
  targeting sequence with TTCN PAM
ucaggauguucacccagaac

SEQ ID NO: 24247 - RNA, 20 nt, Artificial Sequence
  targeting sequence with TTCN PAM
ggauguucacccagaaccgg

SEQ ID NO: 24248 - RNA, 20 nt, Artificial Sequence
  targeting sequence with TTCN PAM
cccagaaccggagaggaagg

SEQ ID NO: 24249 - RNA, 20 nt, Artificial Sequence
  targeting sequence with TTCN PAM
gggugaacauccugaagaac

SEQ ID NO: 24250 - RNA, 20 nt, Artificial Sequence
  targeting sequence with TTCN PAM
ucuccgguucugggugaaca

SEQ ID NO: 24251 - RNA, 20 nt, Artificial Sequence
  targeting sequence with TTCN PAM
uaccccacccuacccucacu

SEQ ID NO: 24252 - RNA, 20 nt, Artificial Sequence
  targeting sequence with TTCN PAM
caaaggucacaucuugugac

SEQ ID NO: 24253 - RNA, 20 nt, Artificial Sequence
  targeting sequence with TTCN PAM
ugcuggagcaaggcaggagc

SEQ ID NO: 24254 - RNA, 20 nt, Artificial Sequence
  targeting sequence with TTCN PAM
cauuagaaccaggugccggc

SEQ ID NO: 24255 - RNA, 20 nt, Artificial Sequence
  targeting sequence with TTCN PAM
aaugagaaccaggaccugac

SEQ ID NO: 24256 - RNA, 20 nt, Artificial Sequence
  targeting sequence with TTCN PAM
gggaggagccaggggugccc

SEQ ID NO: 24257 - RNA, 20 nt, Artificial Sequence
  targeting sequence with TTCN PAM
ugcugccugcaaggguucag

SEQ ID NO: 24258 - RNA, 20 nt, Artificial Sequence
  targeting sequence with TTCN PAM
uagagcucuggggguacaca

SEQ ID NO: 24259 - RNA, 20 nt, Artificial Sequence
  targeting sequence with TTCN PAM
uccugagggucaggcugggu

SEQ ID NO: 24260 - RNA, 20 nt, Artificial Sequence
  targeting sequence with TTCN PAM
ugagggucaggcuggguuuc

SEQ ID NO: 24261 - RNA, 20 nt, Artificial Sequence
  targeting sequence with TTCN PAM
agcaacuucuugugggggug

SEQ ID NO: 24262 - RNA, 20 nt, Artificial Sequence
  targeting sequence with TTCN PAM
ugugggggugcaugaccccg

SEQ ID NO: 24263 - RNA, 20 nt, Artificial Sequence
  targeting sequence with TTCN PAM
gauaauguagggccgagccu

SEQ ID NO: 24264 - RNA, 20 nt, Artificial Sequence
  targeting sequence with TTCN PAM
ccgagccucagugugcuuau

SEQ ID NO: 24265 - RNA, 20 nt, Artificial Sequence
  targeting sequence with TTCN PAM
cagauaagcacacugaggcu

SEQ ID NO: 24266 - RNA, 20 nt, Artificial Sequence
  targeting sequence with TTCN PAM
cccgcaccccucucaggugg

SEQ ID NO: 24267 - RNA, 20 nt, Artificial Sequence
  targeting sequence with TTCN PAM
gggcacucuucuaguuaauu

SEQ ID NO: 24268 - RNA, 20 nt, Artificial Sequence
  targeting sequence with TTCN PAM
aguuaauucccaccauuaac

SEQ ID NO: 24269 - RNA, 20 nt, Artificial Sequence
  targeting sequence with TTCN PAM
caccauuaacaugggucgca

SEQ ID NO: 24270 - RNA, 20 nt, Artificial Sequence
  targeting sequence with TTCN PAM
ccuccacuguaaaaugcgac

SEQ ID NO: 24271 - RNA, 20 nt, Artificial Sequence
  targeting sequence with TTCN PAM
guuuccccuccacuguaaaa

SEQ ID NO: 24272 - RNA, 20 nt, Artificial Sequence
  targeting sequence with TTCN PAM
cggaugagugacuuagccuc

SEQ ID NO: 24273 - RNA, 20 nt, Artificial Sequence
  targeting sequence with TTCN PAM
cagcuguguguucucggaug

SEQ ID NO: 24274 - RNA, 20 nt, Artificial Sequence
  targeting sequence with TTCN PAM
ggccucgccugcuugggguc

SEQ ID NO: 24275 - RNA, 20 nt, Artificial Sequence
  targeting sequence with TTCN PAM
gagucuagucuucuggccuc

SEQ ID NO: 24276 - RNA, 20 nt, Artificial Sequence
  targeting sequence with TTCN PAM
cugugccacuggggccccug

SEQ ID NO: 24277 - RNA, 20 nt, Artificial Sequence
  targeting sequence with TTCN PAM
agauguguagggugucgggg

SEQ ID NO: 24278 - RNA, 20 nt, Artificial Sequence
  targeting sequence with TTCN PAM
ccucuucucagccugcuccu

SEQ ID NO: 24279 - RNA, 20 nt, Artificial Sequence
  targeting sequence with TTCN PAM
cagccugcuccuccaggaag

SEQ ID NO: 24280 - RNA, 20 nt, Artificial Sequence
  targeting sequence with TTCN PAM
uggaggagcaggcugagaag

SEQ ID NO: 24281 - RNA, 20 nt, Artificial Sequence
  targeting sequence with TTCN PAM
acuuccuggaggagcaggcu

SEQ ID NO: 24282 - RNA, 20 nt, Artificial Sequence
  targeting sequence with TTCN PAM
cggauacucagaauggccuu

SEQ ID NO: 24283 - RNA, 20 nt, Artificial Sequence
  targeting sequence with TTCN PAM
gaguauccgugaagacaagc

SEQ ID NO: 24284 - RNA, 20 nt, Artificial Sequence
  targeting sequence with TTCN PAM
aggccauucugaguauccgu

SEQ ID NO: 24285 - RNA, 20 nt, Artificial Sequence
  targeting sequence with TTCN PAM
ggaugaccuguucaaggcca

SEQ ID NO: 24286 - RNA, 20 nt, Artificial Sequence
  targeting sequence with TTCN PAM
gcaacgugcccugcggggga

SEQ ID NO: 24287 - RNA, 20 nt, Artificial Sequence
  targeting sequence with TTCN PAM
agcuccgcagagccaccaag

SEQ ID NO: 24288 - RNA, 20 nt, Artificial Sequence
  targeting sequence with TTCN PAM
gcagccuggcauuucaagcu

SEQ ID NO: 24289 - RNA, 20 nt, Artificial Sequence
  targeting sequence with TTCN PAM
ucauucagcagccuggcauu

SEQ ID NO: 24290 - RNA, 20 nt, Artificial Sequence
  targeting sequence with TTCN PAM
acgccucugggaggcaagug

SEQ ID NO: 24291 - RNA, 20 nt, Artificial Sequence
  targeting sequence with TTCN PAM
cgacuccaugugccagugcc

SEQ ID NO: 24292 - RNA, 20 nt, Artificial Sequence
  targeting sequence with TTCN PAM
aguucucgacuccaugugcc

SEQ ID NO: 24293 - RNA, 20 nt, Artificial Sequence
  targeting sequence with TTCN PAM
auguuagcccacguaacagg

SEQ ID NO: 24294 - RNA, 20 nt, Artificial Sequence
  targeting sequence with TTCN PAM
uggcugugagaaaugccucc

SEQ ID NO: 24295 - RNA, 20 nt, Artificial Sequence
  targeting sequence with TTCN PAM
cacagccaggaaaaaugccu

SEQ ID NO: 24296 - RNA, 20 nt, Artificial Sequence
  targeting sequence with TTCN PAM
gccucuugccccuccagccc

SEQ ID NO: 24297 - RNA, 20 nt, Artificial Sequence
  targeting sequence with TTCN PAM
ccuguggggcuggaggggca

SEQ ID NO: 24298 - RNA, 20 nt, Artificial Sequence
  targeting sequence with TTCN PAM
uguuuccccuguggggcugg

SEQ ID NO: 24299 - RNA, 20 nt, Artificial Sequence
  targeting sequence with TTCN PAM
uccuguuuccccuguggggc

SEQ ID NO: 24300 - RNA, 20 nt, Artificial Sequence
  targeting sequence with TTCN PAM
gggagcaccuucuugcgaug

SEQ ID NO: 24301 - RNA, 20 nt, Artificial Sequence
  targeting sequence with TTCN PAM
ugcgauggcucugccgguga

SEQ ID NO: 24302 - RNA, 20 nt, Artificial Sequence
  targeting sequence with TTCN PAM
ugggcuccgccagcucgucc

SEQ ID NO: 24303 - RNA, 20 nt, Artificial Sequence
  targeting sequence with TTCN PAM
uagcacacaagggcuguggu

SEQ ID NO: 24304 - RNA, 20 nt, Artificial Sequence
  targeting sequence with TTCN PAM
cuccugauucugggccccau

SEQ ID NO: 24305 - RNA, 20 nt, Artificial Sequence
  targeting sequence with TTCN PAM
gggccccaucccuacucccc

SEQ ID NO: 24306 - RNA, 20 nt, Artificial Sequence
  targeting sequence with TTCN PAM
cagggcugggagcacuuuuc

SEQ ID NO: 24307 - RNA, 20 nt, Artificial Sequence
  targeting sequence with TTCN PAM
caagaggcccagggccacag

SEQ ID NO: 24308 - RNA, 20 nt, Artificial Sequence
  targeting sequence with TTCN PAM
guggcccugggccucuuggg

SEQ ID NO: 24309 - RNA, 20 nt, Artificial Sequence
  targeting sequence with TTCN PAM
auuuggugagugcccaaccu

SEQ ID NO: 24310 - RNA, 20 nt, Artificial Sequence
  targeting sequence with TTCN PAM
cuguguccaagucuuucacu

SEQ ID NO: 24311 - RNA, 20 nt, Artificial Sequence
  targeting sequence with TTCN PAM
cugugagaggaaaaacacaa

SEQ ID NO: 24312 - RNA, 20 nt, Artificial Sequence
  targeting sequence with TTCN PAM
ucucacagugaaagacuugg

SEQ ID NO: 24313 - RNA, 20 nt, Artificial Sequence
  targeting sequence with TTCN PAM
cuccucuccucucccguguu

SEQ ID NO: 24314 - RNA, 20 nt, Artificial Sequence
  targeting sequence with TTCN PAM
guuucucuccucuccucucc

SEQ ID NO: 24315 - RNA, 20 nt, Artificial Sequence
  targeting sequence with TTCN PAM
uuucuguuucucuccucucc

SEQ ID NO: 24316 - RNA, 20 nt, Artificial Sequence
  targeting sequence with TTCN PAM
gucuucauuucuguuucucu

SEQ ID NO: 24317 - RNA, 20 nt, Artificial Sequence
  targeting sequence with TTCN PAM
cacuccaucuuucugucuuc

SEQ ID NO: 24318 - RNA, 20 nt, Artificial Sequence
  targeting sequence with TTCN PAM
guuucucacuccaucuuucu

SEQ ID NO: 24319 - RNA, 20 nt, Artificial Sequence
  targeting sequence with TTCN PAM
gucuuguuucuguuucucac

SEQ ID NO: 24320 - RNA, 20 nt, Artificial Sequence
  targeting sequence with TTCN PAM
cuccccaucuuucugucuug

SEQ ID NO: 24321 - RNA, 20 nt, Artificial Sequence
  targeting sequence with TTCN PAM
guuucucuccccaucuuucu

SEQ ID NO: 24322 - RNA, 20 nt, Artificial Sequence
  targeting sequence with TTCN PAM
gucucugcuucuguuucucu

SEQ ID NO: 24323 - RNA, 20 nt, Artificial Sequence
  targeting sequence with TTCN PAM
cucuccaucuuucugucucu

SEQ ID NO: 24324 - RNA, 20 nt, Artificial Sequence
  targeting sequence with TTCN PAM
guuucucucuccaucuuucu

SEQ ID NO: 24325 - RNA, 20 nt, Artificial Sequence
  targeting sequence with TTCN PAM
cucugacugucucuuuggau

SEQ ID NO: 24326 - RNA, 20 nt, Artificial Sequence
  targeting sequence with TTCN PAM
cucucugccucacucugucu

SEQ ID NO: 24327 - RNA, 20 nt, Artificial Sequence
  targeting sequence with TTCN PAM
aagucccuccaucccggguc

SEQ ID NO: 24328 - RNA, 20 nt, Artificial Sequence
  targeting sequence with TTCN PAM
cuccaccgcugucccuccuu

SEQ ID NO: 24329 - RNA, 20 nt, Artificial Sequence
  targeting sequence with TTCN PAM
uguuucucuccaccgcuguc

SEQ ID NO: 24330 - RNA, 20 nt, Artificial Sequence
  targeting sequence with TTCN PAM
caggcugcugggagagacug

SEQ ID NO: 24331 - RNA, 20 nt, Artificial Sequence
  targeting sequence with TTCN PAM
aagguugagagcagagucuc

SEQ ID NO: 24332 - RNA, 20 nt, Artificial Sequence
  targeting sequence with TTCN PAM
ggccuggcugcugcccagac

SEQ ID NO: 24333 - RNA, 20 nt, Artificial Sequence
  targeting sequence with TTCN PAM
aggaggucugggcagcagcc

SEQ ID NO: 24334 - RNA, 20 nt, Artificial Sequence
  targeting sequence with TTCN PAM
ugcggcagcuggagagaggc

SEQ ID NO: 24335 - RNA, 20 nt, Artificial Sequence
  targeting sequence with TTCN PAM
ccacuggggcaugggaugga

SEQ ID NO: 24336 - RNA, 20 nt, Artificial Sequence
  targeting sequence with TTCN PAM
aucccaugccccagugggga

SEQ ID NO: 24337 - RNA, 20 nt, Artificial Sequence
  targeting sequence with TTCN PAM
cacgugcacccgcacuaccu

SEQ ID NO: 24338 - RNA, 20 nt, Artificial Sequence
  targeting sequence with TTCN PAM
ugucuaugagacucauggcc

SEQ ID NO: 24339 - RNA, 20 nt, Artificial Sequence
  targeting sequence with TTCN PAM
gggaucugaugggaggggag

SEQ ID NO: 24340 - RNA, 20 nt, Artificial Sequence
  targeting sequence with TTCN PAM
ccacccucaugcccccaccc

SEQ ID NO: 24341 - RNA, 20 nt, Artificial Sequence
  targeting sequence with TTCN PAM
ugcggccgucuuccaccacu

SEQ ID NO: 24342 - RNA, 20 nt, Artificial Sequence
  targeting sequence with TTCN PAM
accacugaggugucguccag

SEQ ID NO: 24343 - RNA, 20 nt, Artificial Sequence
  targeting sequence with TTCN PAM
ggaccuggacgacaccucag

SEQ ID NO: 24344 - RNA, 20 nt, Artificial Sequence
  targeting sequence with TTCN PAM
ccuccagcacacagagcuac

SEQ ID NO: 24345 - RNA, 20 nt, Artificial Sequence
  targeting sequence with TTCN PAM
caucuguaaaauggggaggg

SEQ ID NO: 24346 - RNA, 20 nt, Artificial Sequence
  targeting sequence with TTCN PAM
ugcccuccccauuuuacaga

SEQ ID NO: 24347 - RNA, 20 nt, Artificial Sequence
  targeting sequence with TTCN PAM
cuuuguacccucacacucuc

SEQ ID NO: 24348 - RNA, 20 nt, Artificial Sequence
  targeting sequence with TTCN PAM
agagcuccuccucugugccc

SEQ ID NO: 24349 - RNA, 20 nt, Artificial Sequence
  targeting sequence with TTCN PAM
uguuacaauugcugaugaaa

SEQ ID NO: 24350 - RNA, 20 nt, Artificial Sequence
  targeting sequence with TTCN PAM
ucagcaauuguaacaugaac

SEQ ID NO: 24351 - RNA, 20 nt, Artificial Sequence
  targeting sequence with TTCN PAM
agaccagccugggcagcaca

SEQ ID NO: 24352 - RNA, 20 nt, Artificial Sequence
  targeting sequence with TTCN PAM
gccuccugaguagcugggac

SEQ ID NO: 24353 - RNA, 20 nt, Artificial Sequence
  targeting sequence with TTCN PAM
gucacccaggcuggagugca

SEQ ID NO: 24354 - RNA, 20 nt, Artificial Sequence
  targeting sequence with TTCN PAM
uaaaggagggaugcuggagu

SEQ ID NO: 24355 - RNA, 20 nt, Artificial Sequence
  targeting sequence with TTCN PAM
uaauuccuaaaggagggaug

SEQ ID NO: 24356 - RNA, 20 nt, Artificial Sequence
  targeting sequence with TTCN PAM
ugaaggcuuuuugcuguugu

SEQ ID NO: 24357 - RNA, 20 nt, Artificial Sequence
  targeting sequence with TTCN PAM
ggaaaggcuuccuaauuccu

SEQ ID NO: 24358 - RNA, 20 nt, Artificial Sequence
  targeting sequence with TTCN PAM
cucacacugcaggacuuguc

SEQ ID NO: 24359 - RNA, 20 nt, Artificial Sequence
  targeting sequence with TTCN PAM
ugcugagggggccucauugg

SEQ ID NO: 24360 - RNA, 20 nt, Artificial Sequence
  targeting sequence with TTCN PAM
ugcacccaugccaggugaaa

SEQ ID NO: 24361 - RNA, 20 nt, Artificial Sequence
  targeting sequence with TTCN PAM
ccuggcaugggugcaugaau

SEQ ID NO: 24362 - RNA, 20 nt, Artificial Sequence
  targeting sequence with TTCN PAM
cgucaaggcaggggccagcc

SEQ ID NO: 24363 - RNA, 20 nt, Artificial Sequence
  targeting sequence with TTCN PAM
gccggggcuggccccugccu

SEQ ID NO: 24364 - RNA, 20 nt, Artificial Sequence
  targeting sequence with TTCN PAM
cacccaccaaggucgacguc

SEQ ID NO: 24365 - RNA, 20 nt, Artificial Sequence
  targeting sequence with TTCN PAM
ugcagaaggccuccaggauc

SEQ ID NO: 24366 - RNA, 20 nt, Artificial Sequence
  targeting sequence with TTCN PAM
gcaagaaugugcccuacucc

SEQ ID NO: 24367 - RNA, 20 nt, Artificial Sequence
  targeting sequence with TTCN PAM
ccuugaccugugucagcgug

SEQ ID NO: 24368 - RNA, 20 nt, Artificial Sequence
  targeting sequence with TTCN PAM
agggcuguggcauggacucg

SEQ ID NO: 24369 - RNA, 20 nt, Artificial Sequence
  targeting sequence with TTCN PAM
gguucugcagggggagagug

SEQ ID NO: 24370 - RNA, 20 nt, Artificial Sequence
  targeting sequence with TTCN PAM
gcagggggagagugggagag

SEQ ID NO: 24371 - RNA, 20 nt, Artificial Sequence
  targeting sequence with TTCN PAM
cucccacucucccccugcag

SEQ ID NO: 24372 - RNA, 20 nt, Artificial Sequence
  targeting sequence with TTCN PAM
cccgcagcagccacuccuca

SEQ ID NO: 24373 - RNA, 20 nt, Artificial Sequence
  targeting sequence with TTCN PAM
ugcugcugugugccaucaag

SEQ ID NO: 24374 - RNA, 20 nt, Artificial Sequence
  targeting sequence with TTCN PAM
uccugcugcugugugccauc

SEQ ID NO: 24375 - RNA, 20 nt, Artificial Sequence
  targeting sequence with TTCN PAM
uacugugcagccaacagugc

SEQ ID NO: 24376 - RNA, 20 nt, Artificial Sequence
  targeting sequence with TTCN PAM
cagcugggugaucuugggca

SEQ ID NO: 24377 - RNA, 20 nt, Artificial Sequence
  targeting sequence with TTCN PAM
acuaaguggggggcccccaa

SEQ ID NO: 24378 - RNA, 20 nt, Artificial Sequence
  targeting sequence with TTCN PAM
gguccaccuaaacucacacu

SEQ ID NO: 24379 - RNA, 20 nt, Artificial Sequence
  targeting sequence with TTCN PAM
uccugagacuccauagucau

SEQ ID NO: 24380 - RNA, 20 nt, Artificial Sequence
  targeting sequence with TTCN PAM
caaggccauugcccagcaag

SEQ ID NO: 24381 - RNA, 20 nt, Artificial Sequence
  targeting sequence with TTCN PAM
acugggauaguuuuacuuaa

SEQ ID NO: 24382 - RNA, 20 nt, Artificial Sequence
  targeting sequence with TTCN PAM
uuaaaucaauuuuuguggau

SEQ ID NO: 24383 - RNA, 20 nt, Artificial Sequence
  targeting sequence with TTCN PAM
uaaucuuugccaaaucugcc

SEQ ID NO: 24384 - RNA, 20 nt, Artificial Sequence
  targeting sequence with TTCN PAM
ccaggucuggggcgugggag

SEQ ID NO: 24385 - RNA, 20 nt, Artificial Sequence
  targeting sequence with TTCN PAM
cugcuuccuagaggaggaaa

SEQ ID NO: 24386 - RNA, 20 nt, Artificial Sequence
  targeting sequence with TTCN PAM
uagaggaggaaacaggcuca

SEQ ID NO: 24387 - RNA, 20 nt, Artificial Sequence
  targeting sequence with TTCN PAM
uccucuaggaagcagggaau

SEQ ID NO: 24388 - RNA, 20 nt, Artificial Sequence
  targeting sequence with TTCN PAM
ccuaugagccuguuuccucc

SEQ ID NO: 24389 - RNA, 20 nt, Artificial Sequence
  targeting sequence with TTCN PAM
guggccucagccaggccuuc

SEQ ID NO: 24390 - RNA, 20 nt, Artificial Sequence
  targeting sequence with TTCN PAM
uucuguggccucagccaggc

SEQ ID NO: 24391 - RNA, 20 nt, Artificial Sequence
  targeting sequence with TTCN PAM
ugauggcccacagugaggca

SEQ ID NO: 24392 - RNA, 20 nt, Artificial Sequence
  targeting sequence with TTCN PAM
gcgggcugccucacuguggg

SEQ ID NO: 24393 - RNA, 20 nt, Artificial Sequence
  targeting sequence with TTCN PAM
cccaggaggagccguggggc

SEQ ID NO: 24394 - RNA, 20 nt, Artificial Sequence
  targeting sequence with TTCN PAM
gucaaauggggccucugccc

SEQ ID NO: 24395 - RNA, 20 nt, Artificial Sequence
  targeting sequence with TTCN PAM
uucugucaaauggggccucu

SEQ ID NO: 24396 - RNA, 20 nt, Artificial Sequence
  targeting sequence with TTCN PAM
aaaauuaauaacaaaaaaca

SEQ ID NO: 24397 - RNA, 20 nt, Artificial Sequence
  targeting sequence with TTCN PAM
guuuuuuguuauuaauuuuu

SEQ ID NO: 24398 - RNA, 20 nt, Artificial Sequence
  targeting sequence with TTCN PAM
gggcuccaggcaggccuuug

SEQ ID NO: 24399 - RNA, 20 nt, Artificial Sequence
  targeting sequence with TTCN PAM
cccacaauccuccaggcagc

SEQ ID NO: 24400 - RNA, 20 nt, Artificial Sequence
  targeting sequence with TTCN PAM
cagagcaaggguugcuuagc

SEQ ID NO: 24401 - RNA, 20 nt, Artificial Sequence
  targeting sequence with TTCN PAM
ggcagagugcaggaggcccu

SEQ ID NO: 24402 - RNA, 20 nt, Artificial Sequence
  targeting sequence with TTCN PAM
cagccuccgcucucauccag

SEQ ID NO: 24403 - RNA, 20 nt, Artificial Sequence
  targeting sequence with TTCN PAM
ggaugagagcggaggcuggg

SEQ ID NO: 24404 - RNA, 20 nt, Artificial Sequence
  targeting sequence with TTCN PAM
uuggccuuccuucuauuccu

SEQ ID NO: 24405 - RNA, 20 nt, Artificial Sequence
  targeting sequence with TTCN PAM
uucuauuccuuccacgaaca

SEQ ID NO: 24406 - RNA, 20 nt, Artificial Sequence
  targeting sequence with TTCN PAM
auuccuuccacgaacauccc

SEQ ID NO: 24407 - RNA, 20 nt, Artificial Sequence
  targeting sequence with TTCN PAM
uuccacgaacauccccuccu

SEQ ID NO: 24408 - RNA, 20 nt, Artificial Sequence
  targeting sequence with TTCN PAM
acgaacauccccuccucccg

SEQ ID NO: 24409 - RNA, 20 nt, Artificial Sequence
  targeting sequence with TTCN PAM
uggaaggaauagaaggaagg

SEQ ID NO: 24410 - RNA, 20 nt, Artificial Sequence
  targeting sequence with TTCN PAM
uggagcaggcaacccugugc

SEQ ID NO: 24411 - RNA, 20 nt, Artificial Sequence
  targeting sequence with TTCN PAM
agguggcuuccuggagcagg

SEQ ID NO: 24412 - RNA, 20 nt, Artificial Sequence
  targeting sequence with TTCN PAM
gacagagggaggccucguga

SEQ ID NO: 24413 - RNA, 20 nt, Artificial Sequence
  targeting sequence with TTCN PAM
acgucucgccuagccuaggg

SEQ ID NO: 24414 - RNA, 20 nt, Artificial Sequence
  targeting sequence with TTCN PAM
ucuccugaauccagagcagg

SEQ ID NO: 24415 - RNA, 20 nt, Artificial Sequence
  targeting sequence with TTCN PAM
ggagaugaaaucagccccug

SEQ ID NO: 24416 - RNA, 20 nt, Artificial Sequence
  targeting sequence with TTCN PAM
cugcucuggauucaggagau

SEQ ID NO: 24417 - RNA, 20 nt, Artificial Sequence
  targeting sequence with TTCN PAM
cagucauccacccuucccug

SEQ ID NO: 24418 - RNA, 20 nt, Artificial Sequence
  targeting sequence with TTCN PAM
ccggggccauggcuccccuc

SEQ ID NO: 24419 - RNA, 20 nt, Artificial Sequence
  targeting sequence with TTCN PAM
cuggcacccucaggccagcu

SEQ ID NO: 24420 - RNA, 20 nt, Artificial Sequence
  targeting sequence with TTCN PAM
ccaccacagacucugugcgc

SEQ ID NO: 24421 - RNA, 20 nt, Artificial Sequence
  targeting sequence with TTCN PAM
uggcggccgaggcgucaaug

SEQ ID NO: 24422 - RNA, 20 nt, Artificial Sequence
  targeting sequence with TTCN PAM
ugaugcugguguaguacucc

SEQ ID NO: 24423 - RNA, 20 nt, Artificial Sequence
  targeting sequence with TTCN PAM
cuaccccaccccagucuguc

SEQ ID NO: 24424 - RNA, 20 nt, Artificial Sequence
  targeting sequence with TTCN PAM
gcugcuccagcgcguggaca

SEQ ID NO: 24425 - RNA, 20 nt, Artificial Sequence
  targeting sequence with TTCN PAM
ucaucgucuuuguccacgcg

SEQ ID NO: 24426 - RNA, 20 nt, Artificial Sequence
  targeting sequence with TTCN PAM
ccucacuacucaacaacaag

SEQ ID NO: 24427 - RNA, 20 nt, Artificial Sequence
  targeting sequence with TTCN PAM
cucuuccauguugggccggc

SEQ ID NO: 24428 - RNA, 20 nt, Artificial Sequence
  targeting sequence with TTCN PAM
auguugggccggcagcucuc

SEQ ID NO: 24429 - RNA, 20 nt, Artificial Sequence
  targeting sequence with TTCN PAM
ugagagcugccggcccaaca

SEQ ID NO: 24430 - RNA, 20 nt, Artificial Sequence
  targeting sequence with TTCN PAM
acagauuccugagagcugcc

SEQ ID NO: 24431 - RNA, 20 nt, Artificial Sequence
  targeting sequence with TTCN PAM
acgguggaugccuccuaacc

SEQ ID NO: 24432 - RNA, 20 nt, Artificial Sequence
  targeting sequence with TTCN PAM
gggcaacccugcuccccccu

SEQ ID NO: 24433 - RNA, 20 nt, Artificial Sequence
  targeting sequence with TTCN PAM
acucucccagcagugggugg

SEQ ID NO: 24434 - RNA, 20 nt, Artificial Sequence
  targeting sequence with TTCN PAM
ugugccugggagcugcccug

SEQ ID NO: 24435 - RNA, 20 nt, Artificial Sequence
  targeting sequence with TTCN PAM
uaaagggaggaacacugcag

SEQ ID NO: 24436 - RNA, 20 nt, Artificial Sequence
  targeting sequence with TTCN PAM
ucccuuuaugaagagcguua

SEQ ID NO: 24437 - RNA, 20 nt, Artificial Sequence
  targeting sequence with TTCN PAM
augccagcagggggugucca

SEQ ID NO: 24438 - RNA, 20 nt, Artificial Sequence
  targeting sequence with TTCN PAM
gugugagugaccuuuccaug

SEQ ID NO: 24439 - RNA, 20 nt, Artificial Sequence
  targeting sequence with TTCN PAM
cccagcagcccaagccagug

SEQ ID NO: 24440 - RNA, 20 nt, Artificial Sequence
  targeting sequence with TTCN PAM
gugccaguuucccccagcag

SEQ ID NO: 24441 - RNA, 20 nt, Artificial Sequence
  targeting sequence with TTCN PAM
acagcccccaggcuuggccc

SEQ ID NO: 24442 - RNA, 20 nt, Artificial Sequence
  targeting sequence with TTCN PAM
agggguguggccacacaaga

SEQ ID NO: 24443 - RNA, 20 nt, Artificial Sequence
  targeting sequence with TTCN PAM
ccuuaagucuugugcugucu

SEQ ID NO: 24444 - RNA, 20 nt, Artificial Sequence
  targeting sequence with TTCN PAM
cccauugcacauggagcugc

SEQ ID NO: 24445 - RNA, 20 nt, Artificial Sequence
  targeting sequence with TTCN PAM
gccucaguuucccccauugc

SEQ ID NO: 24446 - RNA, 20 nt, Artificial Sequence
  targeting sequence with TTCN PAM
cagccucaggcuaaagcuca

SEQ ID NO: 24447 - RNA, 20 nt, Artificial Sequence
  targeting sequence with TTCN PAM
ugaaaaaugauguagucaaa

SEQ ID NO: 24448 - RNA, 20 nt, Artificial Sequence
  targeting sequence with TTCN PAM
cgaaacccuccaguagcuuu

SEQ ID NO: 24449 - RNA, 20 nt, Artificial Sequence
  targeting sequence with TTCN PAM
ccacacaguggccaaagcaa

SEQ ID NO: 24450 - RNA, 20 nt, Artificial Sequence
  targeting sequence with TTCN PAM
aggguccacuacccucacuc

SEQ ID NO: 24451 - RNA, 20 nt, Artificial Sequence
  targeting sequence with TTCN PAM
augccucucaugccuccccu

SEQ ID NO: 24452 - RNA, 20 nt, Artificial Sequence
  targeting sequence with TTCN PAM
cuuggucucuacacucccuc

SEQ ID NO: 24453 - RNA, 20 nt, Artificial Sequence
  targeting sequence with TTCN PAM
cagccaggcuucccuugguc

SEQ ID NO: 24454 - RNA, 20 nt, Artificial Sequence
  targeting sequence with TTCN PAM
ugugccucuucccagccagg

SEQ ID NO: 24455 - RNA, 20 nt, Artificial Sequence
  targeting sequence with TTCN PAM
gccccaccuugaaaagggga

SEQ ID NO: 24456 - RNA, 20 nt, Artificial Sequence
  targeting sequence with TTCN PAM
agguggggcagaagcggcca

SEQ ID NO: 24457 - RNA, 20 nt, Artificial Sequence
  targeting sequence with TTCN PAM
auauggacuguuaaacauca

SEQ ID NO: 24458 - RNA, 20 nt, Artificial Sequence
  targeting sequence with TTCN PAM
cugcucacuugauguuuaac

SEQ ID NO: 24459 - RNA, 20 nt, Artificial Sequence
  targeting sequence with TTCN PAM
ccacugucauucucugcuca

SEQ ID NO: 24460 - RNA, 20 nt, Artificial Sequence
  targeting sequence with TTCN PAM
ccccguggcaggccagggca

SEQ ID NO: 24461 - RNA, 20 nt, Artificial Sequence
  targeting sequence with TTCN PAM
gggcaggcucaggcucgggc

SEQ ID NO: 24462 - RNA, 20 nt, Artificial Sequence
  targeting sequence with TTCN PAM
ccaaggucagcccgagccug

SEQ ID NO: 24463 - RNA, 20 nt, Artificial Sequence
  targeting sequence with TTCN PAM
uccccaaggucagcccgagc

SEQ ID NO: 24464 - RNA, 20 nt, Artificial Sequence
  targeting sequence with TTCN PAM
ugacccgcaccuucuucccc

SEQ ID NO: 24465 - RNA, 20 nt, Artificial Sequence
  targeting sequence with TTCN PAM
uggaguauaagcacuucgug

SEQ ID NO: 24466 - RNA, 20 nt, Artificial Sequence
  targeting sequence with TTCN PAM
gcuccuuggugagaucuguc

SEQ ID NO: 24467 - RNA, 20 nt, Artificial Sequence
  targeting sequence with TTCN PAM
cugagcugcagacagacaug

SEQ ID NO: 24468 - RNA, 20 nt, Artificial Sequence
  targeting sequence with TTCN PAM
cgggccgcucacggcugucc

SEQ ID NO: 24469 - RNA, 20 nt, Artificial Sequence
  targeting sequence with TTCN PAM
cuccuaggggauggguucuc

SEQ ID NO: 24470 - RNA, 20 nt, Artificial Sequence
  targeting sequence with TTCN PAM
ucucggaucugagauuccau

SEQ ID NO: 24471 - RNA, 20 nt, Artificial Sequence
  targeting sequence with TTCN PAM
aucuccuccaucugcagcag

SEQ ID NO: 24472 - RNA, 20 nt, Artificial Sequence
  targeting sequence with TTCN PAM
gccaguaacgcucagcacgu

SEQ ID NO: 24473 - RNA, 20 nt, Artificial Sequence
  targeting sequence with TTCN PAM
guaccaagagccgacgugcu

SEQ ID NO: 24474 - RNA, 20 nt, Artificial Sequence
  targeting sequence with TTCN PAM
ucuucuguaccaagagccga

SEQ ID NO: 24475 - RNA, 20 nt, Artificial Sequence
  targeting sequence with TTCN PAM
aaagggcaccagaggccuga

SEQ ID NO: 24476 - RNA, 20 nt, Artificial Sequence
  targeting sequence with TTCN PAM
ggccuccgcuccagcuccuc

SEQ ID NO: 24477 - RNA, 20 nt, Artificial Sequence
  targeting sequence with TTCN PAM
ccaagcccucuguccacggg

SEQ ID NO: 24478 - RNA, 20 nt, Artificial Sequence
  targeting sequence with TTCN PAM
aaggacgggucaucaggcau

SEQ ID NO: 24479 - RNA, 20 nt, Artificial Sequence
  targeting sequence with TTCN PAM
uuuucuaaggacgggucauc

SEQ ID NO: 24480 - RNA, 20 nt, Artificial Sequence
  targeting sequence with TTCN PAM
aacagagcuguaacacuaca

SEQ ID NO: 24481 - RNA, 20 nt, Artificial Sequence
  targeting sequence with TTCN PAM
uuuuuuuuuuaacggggcua

SEQ ID NO: 24482 - RNA, 20 nt, Artificial Sequence
  targeting sequence with TTCN PAM
uguuucuuuuuuuuuuuaac

SEQ ID NO: 24483 - RNA, 20 nt, Artificial Sequence
  targeting sequence with TTCN PAM
cacacacguauuccuguuuc

SEQ ID NO: 24484 - RNA, 20 nt, Artificial Sequence
  targeting sequence with TTCN PAM
ugggugggaggauucugggu

SEQ ID NO: 24485 - RNA, 20 nt, Artificial Sequence
  targeting sequence with TTCN PAM
gggugacuucgguuuacuuu

SEQ ID NO: 24486 - RNA, 20 nt, Artificial Sequence
  targeting sequence with TTCN PAM
guuuacuuucugcuuuugag

SEQ ID NO: 24487 - RNA, 20 nt, Artificial Sequence
  targeting sequence with TTCN PAM
gcuuuugagcauuuucuauu

SEQ ID NO: 24488 - RNA, 20 nt, Artificial Sequence
  targeting sequence with TTCN PAM
auuccuucuacaaugaccag

SEQ ID NO: 24489 - RNA, 20 nt, Artificial Sequence
  targeting sequence with TTCN PAM
uucuacaaugaccagguguu

SEQ ID NO: 24490 - RNA, 20 nt, Artificial Sequence
  targeting sequence with TTCN PAM
acaaugaccagguguuacuu

SEQ ID NO: 24491 - RNA, 20 nt, Artificial Sequence
  targeting sequence with TTCN PAM
uaauuuacaaguaacaccug

SEQ ID NO: 24492 - RNA, 20 nt, Artificial Sequence
  targeting sequence with TTCN PAM
ugggguggggaggaauauau

SEQ ID NO: 24493 - RNA, 20 nt, Artificial Sequence
  targeting sequence with TTCN PAM
augguuucuaguauauucac

SEQ ID NO: 24494 - RNA, 20 nt, Artificial Sequence
  targeting sequence with TTCN PAM
aguauauucacagaguugug

SEQ ID NO: 24495 - RNA, 20 nt, Artificial Sequence
  targeting sequence with TTCN PAM
cagaguugugcaaccaucac

SEQ ID NO: 24496 - RNA, 20 nt, Artificial Sequence
  targeting sequence with TTCN PAM
uggggcagcaaaaaugcucu

SEQ ID NO: 24497 - RNA, 20 nt, Artificial Sequence
  targeting sequence with TTCN PAM
uguucucccuagucccuggc

SEQ ID NO: 24498 - RNA, 20 nt, Artificial Sequence
  targeting sequence with TTCN PAM
cccuagucccuggcaaucac

SEQ ID NO: 24499 - RNA, 20 nt, Artificial Sequence
  targeting sequence with TTCN PAM
gcuuucugucucuaugaauu

SEQ ID NO: 24500 - RNA, 20 nt, Artificial Sequence
  targeting sequence with TTCN PAM
gucucuaugaauuucccuau

SEQ ID NO: 24501 - RNA, 20 nt, Artificial Sequence
  targeting sequence with TTCN PAM
uagagacagaaagcugaaug

SEQ ID NO: 24502 - RNA, 20 nt, Artificial Sequence
  targeting sequence with TTCN PAM
cuauucuaaacauuucauau

SEQ ID NO: 24503 - RNA, 20 nt, Artificial Sequence
  targeting sequence with TTCN PAM
aaacauuucauauaaauggc

SEQ ID NO: 24504 - RNA, 20 nt, Artificial Sequence
  targeting sequence with TTCN PAM
ugaguaauccucucuuaagu

SEQ ID NO: 24505 - RNA, 20 nt, Artificial Sequence
  targeting sequence with TTCN PAM
guagcucucuauugacugga

SEQ ID NO: 24506 - RNA, 20 nt, Artificial Sequence
  targeting sequence with TTCN PAM
ccagucaauagagagcuacu

SEQ ID NO: 24507 - RNA, 20 nt, Artificial Sequence
  targeting sequence with TTCN PAM
aaauuucucugcuugagauu

SEQ ID NO: 24508 - RNA, 20 nt, Artificial Sequence
  targeting sequence with TTCN PAM
cugcuugagauucagggacc

SEQ ID NO: 24509 - RNA, 20 nt, Artificial Sequence
  targeting sequence with TTCN PAM
gggaccugggcgugggccua

SEQ ID NO: 24510 - RNA, 20 nt, Artificial Sequence
  targeting sequence with TTCN PAM
acccauuggugcuggagcca

SEQ ID NO: 24511 - RNA, 20 nt, Artificial Sequence
  targeting sequence with TTCN PAM
cauggccaagccuuuguuca

SEQ ID NO: 24512 - RNA, 20 nt, Artificial Sequence
  targeting sequence with TTCN PAM
agcugugccccaucccaucc

SEQ ID NO: 24513 - RNA, 20 nt, Artificial Sequence
  targeting sequence with TTCN PAM
cccaucugccaaucuucaga

SEQ ID NO: 24514 - RNA, 20 nt, Artificial Sequence
  targeting sequence with TTCN PAM
gaggggcuggggcaaggugg

SEQ ID NO: 24515 - RNA, 20 nt, Artificial Sequence
  targeting sequence with TTCN PAM
accagaccaucgccacacug

SEQ ID NO: 24516 - RNA, 20 nt, Artificial Sequence
  targeting sequence with TTCN PAM
cuaccuggaucugugcagag

SEQ ID NO: 24517 - RNA, 20 nt, Artificial Sequence
  targeting sequence with TTCN PAM
ccaaccucugcacagaucca

SEQ ID NO: 24518 - RNA, 20 nt, Artificial Sequence
  targeting sequence with TTCN PAM
uggacuuauacucuaguucu

SEQ ID NO: 24519 - RNA, 20 nt, Artificial Sequence
  targeting sequence with TTCN PAM
gcuccucacuugcugugugg

SEQ ID NO: 24520 - RNA, 20 nt, Artificial Sequence
  targeting sequence with TTCN PAM
caguguccccaggaggugga

SEQ ID NO: 24521 - RNA, 20 nt, Artificial Sequence
  targeting sequence with TTCN PAM
ucuugcucacucacuacucc

SEQ ID NO: 24522 - RNA, 20 nt, Artificial Sequence
  targeting sequence with TTCN PAM
cggggccuggcugcuguccc

SEQ ID NO: 24523 - RNA, 20 nt, Artificial Sequence
  targeting sequence with TTCN PAM
ccugcaccucagucccaguc

SEQ ID NO: 24524 - RNA, 20 nt, Artificial Sequence
  targeting sequence with TTCN PAM
uucaccugcaccucaguccc

SEQ ID NO: 24525 - RNA, 20 nt, Artificial Sequence
  targeting sequence with TTCN PAM
cagucagagccauccugggg

SEQ ID NO: 24526 - RNA, 20 nt, Artificial Sequence
  targeting sequence with TTCN PAM
ggccccucucugcuccuccu

SEQ ID NO: 24527 - RNA, 20 nt, Artificial Sequence
  targeting sequence with TTCN PAM
uaugguuucugaugguccag

SEQ ID NO: 24528 - RNA, 20 nt, Artificial Sequence
  targeting sequence with TTCN PAM
gaugguccagguccagaugg

SEQ ID NO: 24529 - RNA, 20 nt, Artificial Sequence
  targeting sequence with TTCN PAM
ugggccucaguuuccucaua

SEQ ID NO: 24530 - RNA, 20 nt, Artificial Sequence
  targeting sequence with TTCN PAM
ucauaugucaaguggggaug

SEQ ID NO: 24531 - RNA, 20 nt, Artificial Sequence
  targeting sequence with TTCN PAM
cgcucaacagcucaguccag

SEQ ID NO: 24532 - RNA, 20 nt, Artificial Sequence
  targeting sequence with TTCN PAM
cugagcguuuucacgcucaa

SEQ ID NO: 24533 - RNA, 20 nt, Artificial Sequence
  targeting sequence with TTCN PAM
ggugcugggugaggggcaga

SEQ ID NO: 24534 - RNA, 20 nt, Artificial Sequence
  targeting sequence with TTCN PAM
gucagagacaaucuggaugu

SEQ ID NO: 24535 - RNA, 20 nt, Artificial Sequence
  targeting sequence with TTCN PAM
gugggugcaaagggggagga

SEQ ID NO: 24536 - RNA, 20 nt, Artificial Sequence
  targeting sequence with TTCN PAM
ccaugagcauccucccccuu

SEQ ID NO: 24537 - RNA, 20 nt, Artificial Sequence
  targeting sequence with TTCN PAM
cccucuuggccguagagaac

SEQ ID NO: 24538 - RNA, 20 nt, Artificial Sequence
  targeting sequence with TTCN PAM
cuacggccaagagggagaag

SEQ ID NO: 24539 - RNA, 20 nt, Artificial Sequence
  targeting sequence with TTCN PAM
gccuggacuaccuccccaac

SEQ ID NO: 24540 - RNA, 20 nt, Artificial Sequence
  targeting sequence with TTCN PAM
ucaaugggcgggccuacgca

SEQ ID NO: 24541 - RNA, 20 nt, Artificial Sequence
  targeting sequence with TTCN PAM
ucaucaaugggcgggccuac

SEQ ID NO: 24542 - RNA, 20 nt, Artificial Sequence
  targeting sequence with TTCN PAM
caacuccacccucaucaccu

SEQ ID NO: 24543 - RNA, 20 nt, Artificial Sequence
  targeting sequence with TTCN PAM
ccaugcccaucuguccaucc

SEQ ID NO: 24544 - RNA, 20 nt, Artificial Sequence
  targeting sequence with TTCN PAM
ucccucugccucugugucuc

SEQ ID NO: 24545 - RNA, 20 nt, Artificial Sequence
  targeting sequence with TTCN PAM
ggggccugaugggugggagg

SEQ ID NO: 24546 - RNA, 20 nt, Artificial Sequence
  targeting sequence with TTCN PAM
gcaccauguggaaacgcuca

SEQ ID NO: 24547 - RNA, 20 nt, Artificial Sequence
  targeting sequence with TTCN PAM
acauggugcagaaugugucc

SEQ ID NO: 24548 - RNA, 20 nt, Artificial Sequence
  targeting sequence with TTCN PAM
cccaggcucucuggggcugc

SEQ ID NO: 24549 - RNA, 20 nt, Artificial Sequence
  targeting sequence with TTCN PAM
gcauguaccagaaggugagg

SEQ ID NO: 24550 - RNA, 20 nt, Artificial Sequence
  targeting sequence with TTCN PAM
gguacaugcagaacccgguc

SEQ ID NO: 24551 - RNA, 20 nt, Artificial Sequence
  targeting sequence with TTCN PAM
agcgucggggcugcgugcac

SEQ ID NO: 24552 - RNA, 20 nt, Artificial Sequence
  targeting sequence with TTCN PAM
gcugcucacccaccgccaau

SEQ ID NO: 24553 - RNA, 20 nt, Artificial Sequence
  targeting sequence with TTCN PAM
aggccuccuugacugguccc

SEQ ID NO: 24554 - RNA, 20 nt, Artificial Sequence
  targeting sequence with TTCN PAM
gcccaguuagugcccagcug

SEQ ID NO: 24555 - RNA, 20 nt, Artificial Sequence
  targeting sequence with TTCN PAM
uuacacuuccaaauuccgcc

SEQ ID NO: 24556 - RNA, 20 nt, Artificial Sequence
  targeting sequence with TTCN PAM
aaauuccgccccaucccacc

SEQ ID NO: 24557 - RNA, 20 nt, Artificial Sequence
  targeting sequence with TTCN PAM
gccccaucccaccuccucca

SEQ ID NO: 24558 - RNA, 20 nt, Artificial Sequence
  targeting sequence with TTCN PAM
uggaggaggugggauggggc

SEQ ID NO: 24559 - RNA, 20 nt, Artificial Sequence
  targeting sequence with TTCN PAM
caggucuucucucccgccuc

SEQ ID NO: 24560 - RNA, 20 nt, Artificial Sequence
  targeting sequence with TTCN PAM
cucccgccuccaacccuggu

SEQ ID NO: 24561 - RNA, 20 nt, Artificial Sequence
  targeting sequence with TTCN PAM
ccaggguuggaggcgggaga

SEQ ID NO: 24562 - RNA, 20 nt, Artificial Sequence
  targeting sequence with TTCN PAM
gggaucuggggagagagacu

SEQ ID NO: 24563 - RNA, 20 nt, Artificial Sequence
  targeting sequence with TTCN PAM
cccaauccuagccccacugg

SEQ ID NO: 24564 - RNA, 20 nt, Artificial Sequence
  targeting sequence with TTCN PAM
uacuucccguggguaugucu

SEQ ID NO: 24565 - RNA, 20 nt, Artificial Sequence
  targeting sequence with TTCN PAM
cguggguaugucugcccuuc

SEQ ID NO: 24566 - RNA, 20 nt, Artificial Sequence
  targeting sequence with TTCN PAM
cuugaggucuauguugugcu

SEQ ID NO: 24567 - RNA, 20 nt, Artificial Sequence
  targeting sequence with TTCN PAM
ccaacagacuccaaccacac

SEQ ID NO: 24568 - RNA, 20 nt, Artificial Sequence
  targeting sequence with TTCN PAM
ggcuggcccagggguguggu

SEQ ID NO: 24569 - RNA, 20 nt, Artificial Sequence
  targeting sequence with TTCN PAM
cauuacagcuaucacuuaug

SEQ ID NO: 24570 - RNA, 20 nt, Artificial Sequence
  targeting sequence with TTCN PAM
uccaauuacugguacuauuc

SEQ ID NO: 24571 - RNA, 20 nt, Artificial Sequence
  targeting sequence with TTCN PAM
aauuacugguacuauucuua

SEQ ID NO: 24572 - RNA, 20 nt, Artificial Sequence
  targeting sequence with TTCN PAM
uaccagcugaggaaacugag

SEQ ID NO: 24573 - RNA, 20 nt, Artificial Sequence
  targeting sequence with TTCN PAM
ucagcugguaagaauaguac

SEQ ID NO: 24574 - RNA, 20 nt, Artificial Sequence
  targeting sequence with TTCN PAM
ccucucugagccucaguuuc

SEQ ID NO: 24575 - RNA, 20 nt, Artificial Sequence
  targeting sequence with TTCN PAM
uuggcuguguccccuaagcc

SEQ ID NO: 24576 - RNA, 20 nt, Artificial Sequence
  targeting sequence with TTCN PAM
cugggcuggaagggaugggc

SEQ ID NO: 24577 - RNA, 20 nt, Artificial Sequence
  targeting sequence with TTCN PAM
agcccagagaaaucaauggg

SEQ ID NO: 24578 - RNA, 20 nt, Artificial Sequence
  targeting sequence with TTCN PAM
ccaggaccuggagcucggag

SEQ ID NO: 24579 - RNA, 20 nt, Artificial Sequence
  targeting sequence with TTCN PAM
cauggauggugauccuggug

SEQ ID NO: 24580 - RNA, 20 nt, Artificial Sequence
  targeting sequence with TTCN PAM
ucccacagcugccccugguc

SEQ ID NO: 24581 - RNA, 20 nt, Artificial Sequence
  targeting sequence with TTCN PAM
ccuacgugguaagggggggc

SEQ ID NO: 24582 - RNA, 20 nt, Artificial Sequence
  targeting sequence with TTCN PAM
cggucaccacaccugagagu

SEQ ID NO: 24583 - RNA, 20 nt, Artificial Sequence
  targeting sequence with TTCN PAM
acgccaugccacacuuccaa

SEQ ID NO: 24584 - RNA, 20 nt, Artificial Sequence
  targeting sequence with TTCN PAM
aaugccuucuauguauaauu

SEQ ID NO: 24585 - RNA, 20 nt, Artificial Sequence
  targeting sequence with TTCN PAM
auguauaauuuaccccauca

SEQ ID NO: 24586 - RNA, 20 nt, Artificial Sequence
  targeting sequence with TTCN PAM
cacaguucugcaacuauaag

SEQ ID NO: 24587 - RNA, 20 nt, Artificial Sequence
  targeting sequence with TTCN PAM
gcaacuauaagacacggggg

SEQ ID NO: 24588 - RNA, 20 nt, Artificial Sequence
  targeting sequence with TTCN PAM
caugaucagagacccuuuug

SEQ ID NO: 24589 - RNA, 20 nt, Artificial Sequence
  targeting sequence with TTCN PAM
acacgccugaugcacggccu

SEQ ID NO: 24590 - RNA, 20 nt, Artificial Sequence
  targeting sequence with TTCN PAM
uuuugggaggccgugcauca

SEQ ID NO: 24591 - RNA, 20 nt, Artificial Sequence
  targeting sequence with TTCN PAM
gucucugcucacgcguauuu

SEQ ID NO: 24592 - RNA, 20 nt, Artificial Sequence
  targeting sequence with TTCN PAM
uacggccccucugggccagu

SEQ ID NO: 24593 - RNA, 20 nt, Artificial Sequence
  targeting sequence with TTCN PAM
ucagagcaaggcuuaggugg

SEQ ID NO: 24594 - RNA, 20 nt, Artificial Sequence
  targeting sequence with TTCN PAM
accuaagccuugcucugagg

SEQ ID NO: 24595 - RNA, 20 nt, Artificial Sequence
  targeting sequence with TTCN PAM
uccaccuaagccuugcucug

SEQ ID NO: 24596 - RNA, 20 nt, Artificial Sequence
  targeting sequence with TTCN PAM
cagaggagugggcaucagag

SEQ ID NO: 24597 - RNA, 20 nt, Artificial Sequence
  targeting sequence with TTCN PAM
gcuuggggcaucugcuuuau

SEQ ID NO: 24598 - RNA, 20 nt, Artificial Sequence
  targeting sequence with TTCN PAM
caccacacauccugccguuu

SEQ ID NO: 24599 - RNA, 20 nt, Artificial Sequence
  targeting sequence with TTCN PAM
gcacaggccuggaggccacg

SEQ ID NO: 24600 - RNA, 20 nt, Artificial Sequence
  targeting sequence with TTCN PAM
uggccuccaggccugugccg

SEQ ID NO: 24601 - RNA, 20 nt, Artificial Sequence
  targeting sequence with TTCN PAM
agaaagcagcagagugagga

SEQ ID NO: 24602 - RNA, 20 nt, Artificial Sequence
  targeting sequence with TTCN PAM
ggaagacuguugcuucgugg

SEQ ID NO: 24603 - RNA, 20 nt, Artificial Sequence
  targeting sequence with TTCN PAM
ccagcagugccagccucugc

SEQ ID NO: 24604 - RNA, 20 nt, Artificial Sequence
  targeting sequence with TTCN PAM
uuccucggauggucagcagg

SEQ ID NO: 24605 - RNA, 20 nt, Artificial Sequence
  targeting sequence with TTCN PAM
ucggauggucagcagggucc

SEQ ID NO: 24606 - RNA, 20 nt, Artificial Sequence
  targeting sequence with TTCN PAM
ccccucucucgggucaccug

SEQ ID NO: 24607 - RNA, 20 nt, Artificial Sequence
  targeting sequence with TTCN PAM
gcccacagucacaggcaccc

SEQ ID NO: 24608 - RNA, 20 nt, Artificial Sequence
  targeting sequence with TTCN PAM
ucuaagcagugggucugcac

SEQ ID NO: 24609 - RNA, 20 nt, Artificial Sequence
  targeting sequence with TTCN PAM
aggagcaauguuuggccaug

SEQ ID NO: 24610 - RNA, 20 nt, Artificial Sequence
  targeting sequence with TTCN PAM
ggggauaccaugaucacuaa

SEQ ID NO: 24611 - RNA, 20 nt, Artificial Sequence
  targeting sequence with TTCN PAM
gcccucggugucuccuccac

SEQ ID NO: 24612 - RNA, 20 nt, Artificial Sequence
  targeting sequence with TTCN PAM
cggcccaggcacugggaaca

SEQ ID NO: 24613 - RNA, 20 nt, Artificial Sequence
  targeting sequence with TTCN PAM
cagugccugggccgcgaaga

SEQ ID NO: 24614 - RNA, 20 nt, Artificial Sequence
  targeting sequence with TTCN PAM
uggacagcccugagcccaug

SEQ ID NO: 24615 - RNA, 20 nt, Artificial Sequence
  targeting sequence with TTCN PAM
cgcucagccuccaacuaaag

SEQ ID NO: 24616 - RNA, 20 nt, Artificial Sequence
  targeting sequence with TTCN PAM
gggucgugugcagcugcaaa

SEQ ID NO: 24617 - RNA, 20 nt, Artificial Sequence
  targeting sequence with TTCN PAM
gcccuuuugcagcugcacac

SEQ ID NO: 24618 - RNA, 20 nt, Artificial Sequence
  targeting sequence with TTCN PAM
cccacacagccucgaagauc

SEQ ID NO: 24619 - RNA, 20 nt, Artificial Sequence
  targeting sequence with TTCN PAM
aggcugugugggugaaugag

SEQ ID NO: 24620 - RNA, 20 nt, Artificial Sequence
  targeting sequence with TTCN PAM
cacagggugcagcccuggag

SEQ ID NO: 24621 - RNA, 20 nt, Artificial Sequence
  targeting sequence with TTCN PAM
ggauccagcuuaaaagcccc

SEQ ID NO: 24622 - RNA, 20 nt, Artificial Sequence
  targeting sequence with TTCN PAM
gaagccuucccagaugcugc

SEQ ID NO: 24623 - RNA, 20 nt, Artificial Sequence
  targeting sequence with TTCN PAM
gaacagggggcuuuuaagcu

SEQ ID NO: 24624 - RNA, 20 nt, Artificial Sequence
  targeting sequence with TTCN PAM
cagaugcugcccucaaauca

SEQ ID NO: 24625 - RNA, 20 nt, Artificial Sequence
  targeting sequence with TTCN PAM
caggagcagcaccaauacau

SEQ ID NO: 24626 - RNA, 20 nt, Artificial Sequence
  targeting sequence with TTCN PAM
uguuuaugucccuguggcug

SEQ ID NO: 24627 - RNA, 20 nt, Artificial Sequence
  targeting sequence with TTCN PAM
cgacacaucccagaugcccg

SEQ ID NO: 24628 - RNA, 20 nt, Artificial Sequence
  targeting sequence with TTCN PAM
auggaggagcugaggcccgu

SEQ ID NO: 24629 - RNA, 20 nt, Artificial Sequence
  targeting sequence with TTCN PAM
agggagguggggaggggggu

SEQ ID NO: 24630 - RNA, 20 nt, Artificial Sequence
  targeting sequence with TTCN PAM
cacccaggacgcgccuccag

SEQ ID NO: 24631 - RNA, 20 nt, Artificial Sequence
  targeting sequence with TTCN PAM
ggaccccuccuggaggcgcg

SEQ ID NO: 24632 - RNA, 20 nt, Artificial Sequence
  targeting sequence with TTCN PAM
acuuaccuggaaaaaggcag

SEQ ID NO: 24633 - RNA, 20 nt, Artificial Sequence
  targeting sequence with TTCN PAM
agguaaguagaagccaggcc

SEQ ID NO: 24634 - RNA, 20 nt, Artificial Sequence
  targeting sequence with TTCN PAM
gggagccacccguaggcacg

SEQ ID NO: 24635 - RNA, 20 nt, Artificial Sequence
  targeting sequence with TTCN PAM
ucugcagagcccucaggacu

SEQ ID NO: 24636 - RNA, 20 nt, Artificial Sequence
  targeting sequence with TTCN PAM
guuuccucugcagagcccuc

SEQ ID NO: 24637 - RNA, 20 nt, Artificial Sequence
  targeting sequence with TTCN PAM
gccucccagccucgucugag

SEQ ID NO: 24638 - RNA, 20 nt, Artificial Sequence
  targeting sequence with TTCN PAM
caauaguagaacaggggggc

SEQ ID NO: 24639 - RNA, 20 nt, Artificial Sequence
  targeting sequence with TTCN PAM
acuauugggaaaggugaggc

SEQ ID NO: 24640 - RNA, 20 nt, Artificial Sequence
  targeting sequence with TTCN PAM
cgccauguccaccuuaguga

SEQ ID NO: 24641 - RNA, 20 nt, Artificial Sequence
  targeting sequence with TTCN PAM
uuauucuacaccagaugaga

SEQ ID NO: 24642 - RNA, 20 nt, Artificial Sequence
  targeting sequence with TTCN PAM
acaccagaugagagcaggac

SEQ ID NO: 24643 - RNA, 20 nt, Artificial Sequence
  targeting sequence with TTCN PAM
ccucagggaccccagcccaa

SEQ ID NO: 24644 - RNA, 20 nt, Artificial Sequence
  targeting sequence with TTCN PAM
gugugccucaguuuccuauu

SEQ ID NO: 24645 - RNA, 20 nt, Artificial Sequence
  targeting sequence with TTCN PAM
acuguaggcaaacugcuuug

SEQ ID NO: 24646 - RNA, 20 nt, Artificial Sequence
  targeting sequence with TTCN PAM
uguguugcucauuccacugu

SEQ ID NO: 24647 - RNA, 20 nt, Artificial Sequence
  targeting sequence with TTCN PAM
gugggguuuacacacagcac

SEQ ID NO: 24648 - RNA, 20 nt, Artificial Sequence
  targeting sequence with TTCN PAM
augcccucggauuccguggg

SEQ ID NO: 24649 - RNA, 20 nt, Artificial Sequence
  targeting sequence with TTCN PAM
acucaggccucgaagccacu

SEQ ID NO: 24650 - RNA, 20 nt, Artificial Sequence
  targeting sequence with TTCN PAM
aggccugaguggaaacaugg

SEQ ID NO: 24651 - RNA, 20 nt, Artificial Sequence
  targeting sequence with TTCN PAM
cacagagaccacggcaccac

SEQ ID NO: 24652 - RNA, 20 nt, Artificial Sequence
  targeting sequence with TTCN PAM
uuaaaugccaaauuaaacau

SEQ ID NO: 24653 - RNA, 20 nt, Artificial Sequence
  targeting sequence with TTCN PAM
gagccuccugcacgcccggg

SEQ ID NO: 24654 - RNA, 20 nt, Artificial Sequence
  targeting sequence with TTCN PAM
gcuaguuacuguaauucuca

SEQ ID NO: 24655 - RNA, 20 nt, Artificial Sequence
  targeting sequence with TTCN PAM
cagacaggcuuccucugugc

SEQ ID NO: 24656 - RNA, 20 nt, Artificial Sequence
  targeting sequence with TTCN PAM
ucugugccuccaccccagcu

SEQ ID NO: 24657 - RNA, 20 nt, Artificial Sequence
  targeting sequence with TTCN PAM
ccaucuauaaaaugggaccu

SEQ ID NO: 24658 - RNA, 20 nt, Artificial Sequence
  targeting sequence with TTCN PAM
guagcuucccuaagaucaua

SEQ ID NO: 24659 - RNA, 20 nt, Artificial Sequence
  targeting sequence with TTCN PAM
cuaagaucauacagccacag

SEQ ID NO: 24660 - RNA, 20 nt, Artificial Sequence
  targeting sequence with TTCN PAM
ugagaagauucucugagcuc

SEQ ID NO: 24661 - RNA, 20 nt, Artificial Sequence
  targeting sequence with TTCN PAM
caggaaucccugaagcccug

SEQ ID NO: 24662 - RNA, 20 nt, Artificial Sequence
  targeting sequence with TTCN PAM
cugagcucagugcaaaaagg

SEQ ID NO: 24663 - RNA, 20 nt, Artificial Sequence
  targeting sequence with TTCN PAM
ccgggaugugugcccagaaa

SEQ ID NO: 24664 - RNA, 20 nt, Artificial Sequence
  targeting sequence with TTCN PAM
uuaccuuuuuuaaaaaauuc

SEQ ID NO: 24665 - RNA, 20 nt, Artificial Sequence
  targeting sequence with TTCN PAM
aaccagucucggugcgaggc

SEQ ID NO: 24666 - RNA, 20 nt, Artificial Sequence
  targeting sequence with TTCN PAM
ggugcagccagcagcacucc

SEQ ID NO: 24667 - RNA, 20 nt, Artificial Sequence
  targeting sequence with TTCN PAM
agcuguaccagcugccuguc

SEQ ID NO: 24668 - RNA, 20 nt, Artificial Sequence
  targeting sequence with TTCN PAM
ccaccccucaacucaucccu

SEQ ID NO: 24669 - RNA, 20 nt, Artificial Sequence
  targeting sequence with TTCN PAM
caggcagccccgaugaugag

SEQ ID NO: 24670 - RNA, 20 nt, Artificial Sequence
  targeting sequence with TTCN PAM
ccaucuacgacugcagccgc

SEQ ID NO: 24671 - RNA, 20 nt, Artificial Sequence
  targeting sequence with TTCN PAM
gcccauugacccucacagac

SEQ ID NO: 24672 - RNA, 20 nt, Artificial Sequence
  targeting sequence with TTCN PAM
agaccacgugacuguugaga

SEQ ID NO: 24673 - RNA, 20 nt, Artificial Sequence
  targeting sequence with TTCN PAM
cccccaaccaggguaagcac

SEQ ID NO: 24674 - RNA, 20 nt, Artificial Sequence
  targeting sequence with TTCN PAM
gcccuucccccccaaccagg

SEQ ID NO: 24675 - RNA, 20 nt, Artificial Sequence
  targeting sequence with TTCN PAM
cauagucacaggccaucucc

SEQ ID NO: 24676 - RNA, 20 nt, Artificial Sequence
  targeting sequence with TTCN PAM
gagaucgaugugcgccagga

SEQ ID NO: 24677 - RNA, 20 nt, Artificial Sequence
  targeting sequence with TTCN PAM
ggaccagugccagcgagggc

SEQ ID NO: 24678 - RNA, 20 nt, Artificial Sequence
  targeting sequence with TTCN PAM
agccagcagcauuucuggac

SEQ ID NO: 24679 - RNA, 20 nt, Artificial Sequence
  targeting sequence with TTCN PAM
cccuggccaucugggggcag

SEQ ID NO: 24680 - RNA, 20 nt, Artificial Sequence
  targeting sequence with TTCN PAM
gguugaucuguggggguagu

SEQ ID NO: 24681 - RNA, 20 nt, Artificial Sequence
  targeting sequence with TTCN PAM
ggaggggugggaagucacgg

SEQ ID NO: 24682 - RNA, 20 nt, Artificial Sequence
  targeting sequence with TTCN PAM
caccccuccugaagggucca

SEQ ID NO: 24683 - RNA, 20 nt, Artificial Sequence
  targeting sequence with TTCN PAM
gccucugcugugcccccacc

SEQ ID NO: 24684 - RNA, 20 nt, Artificial Sequence
  targeting sequence with TTCN PAM
gggcucgucuccaaggcauc

SEQ ID NO: 24685 - RNA, 20 nt, Artificial Sequence
  targeting sequence with TTCN PAM
cagggcgggaugccuuggag

SEQ ID NO: 24686 - RNA, 20 nt, Artificial Sequence
  targeting sequence with TTCN PAM
uaaacuacaaagccugcaca

SEQ ID NO: 24687 - RNA, 20 nt, Artificial Sequence
  targeting sequence with TTCN PAM
ggcuuugacacugaggagcu

SEQ ID NO: 24688 - RNA, 20 nt, Artificial Sequence
  targeting sequence with TTCN PAM
ugagcuaauggggcaggcgg

SEQ ID NO: 24689 - RNA, 20 nt, Artificial Sequence
  targeting sequence with TTCN PAM
ccgggccugaccccaucagc

SEQ ID NO: 24690 - RNA, 20 nt, Artificial Sequence
  targeting sequence with TTCN PAM
uccccccgacgcccauuuca

SEQ ID NO: 24691 - RNA, 20 nt, Artificial Sequence
  targeting sequence with TTCN PAM
ccgaagaggaaucugaggcu

SEQ ID NO: 24692 - RNA, 20 nt, Artificial Sequence
  targeting sequence with TTCN PAM
gugaaaugggcgucgggggg

SEQ ID NO: 24693 - RNA, 20 nt, Artificial Sequence
  targeting sequence with TTCN PAM
ucuucggugaaaugggcguc

SEQ ID NO: 24694 - RNA, 20 nt, Artificial Sequence
  targeting sequence with TTCN PAM
cuuugugccucuugccaacu

SEQ ID NO: 24695 - RNA, 20 nt, Artificial Sequence
  targeting sequence with TTCN PAM
acaccccuagccuuaagccu

SEQ ID NO: 24696 - RNA, 20 nt, Artificial Sequence
  targeting sequence with TTCN PAM
uccucccugcaccuugguuc

SEQ ID NO: 24697 - RNA, 20 nt, Artificial Sequence
  targeting sequence with TTCN PAM
aggccccagauaauccuggu

SEQ ID NO: 24698 - RNA, 20 nt, Artificial Sequence
  targeting sequence with TTCN PAM
cuggcucugagggacccucu

SEQ ID NO: 24699 - RNA, 20 nt, Artificial Sequence
  targeting sequence with TTCN PAM
caguguguugucuugucugg

SEQ ID NO: 24700 - RNA, 20 nt, Artificial Sequence
  targeting sequence with TTCN PAM
gccccagccuuccuccuggg

SEQ ID NO: 24701 - RNA, 20 nt, Artificial Sequence
  targeting sequence with TTCN PAM
uccuggggcucccaaacccu

SEQ ID NO: 24702 - RNA, 20 nt, Artificial Sequence
  targeting sequence with TTCN PAM
uggcucccuucugcuuaugg

SEQ ID NO: 24703 - RNA, 20 nt, Artificial Sequence
  targeting sequence with TTCN PAM
gcuuauggaaugaaccuguu

SEQ ID NO: 24704 - RNA, 20 nt, Artificial Sequence
  targeting sequence with TTCN PAM
auaagcagaagggagccaug

SEQ ID NO: 24705 - RNA, 20 nt, Artificial Sequence
  targeting sequence with TTCN PAM
uuccauaagcagaagggagc

SEQ ID NO: 24706 - RNA, 20 nt, Artificial Sequence
  targeting sequence with TTCN PAM
ggcacucaagguccugguga

SEQ ID NO: 24707 - RNA, 20 nt, Artificial Sequence
  targeting sequence with TTCN PAM
agccuccaggcauuugccua

SEQ ID NO: 24708 - RNA, 20 nt, Artificial Sequence
  targeting sequence with TTCN PAM
agaggagagcacagcauagg

SEQ ID NO: 24709 - RNA, 20 nt, Artificial Sequence
  targeting sequence with TTCN PAM
uuccuguuccccuucuacca

SEQ ID NO: 24710 - RNA, 20 nt, Artificial Sequence
  targeting sequence with TTCN PAM
uguuccccuucuaccaaugc

SEQ ID NO: 24711 - RNA, 20 nt, Artificial Sequence
  targeting sequence with TTCN PAM
ccuucuaccaaugcacacau

SEQ ID NO: 24712 - RNA, 20 nt, Artificial Sequence
  targeting sequence with TTCN PAM
accaaugcacacaugaggcc

SEQ ID NO: 24713 - RNA, 20 nt, Artificial Sequence
  targeting sequence with TTCN PAM
gggccucaugugugcauugg

SEQ ID NO: 24714 - RNA, 20 nt, Artificial Sequence
  targeting sequence with TTCN PAM
ccccaggcuuccaugggcuu

SEQ ID NO: 24715 - RNA, 20 nt, Artificial Sequence
  targeting sequence with TTCN PAM
augggcuuugucccagccug

SEQ ID NO: 24716 - RNA, 20 nt, Artificial Sequence
  targeting sequence with TTCN PAM
acuccuucaaucauuuauug

SEQ ID NO: 24717 - RNA, 20 nt, Artificial Sequence
  targeting sequence with TTCN PAM
aucauuuauugagcaacuac

SEQ ID NO: 24718 - RNA, 20 nt, Artificial Sequence
  targeting sequence with TTCN PAM
ccucucagagccucaacguu

SEQ ID NO: 24719 - RNA, 20 nt, Artificial Sequence
  targeting sequence with TTCN PAM
caucuguggcaugagaaucg

SEQ ID NO: 24720 - RNA, 20 nt, Artificial Sequence
  targeting sequence with TTCN PAM
caugccacagaugagaacgu

SEQ ID NO: 24721 - RNA, 20 nt, Artificial Sequence
  targeting sequence with TTCN PAM
cacaccccugcaagggaggc

SEQ ID NO: 24722 - RNA, 20 nt, Artificial Sequence
  targeting sequence with TTCN PAM
ugcaccaggcccggccuaac

SEQ ID NO: 24723 - RNA, 20 nt, Artificial Sequence
  targeting sequence with TTCN PAM
cugcucuggggcaggacaga

SEQ ID NO: 24724 - RNA, 20 nt, Artificial Sequence
  targeting sequence with TTCN PAM
gcgcaucuccucccagcucc

SEQ ID NO: 24725 - RNA, 20 nt, Artificial Sequence
  targeting sequence with TTCN PAM
cugucaagggcuguaagcug

SEQ ID NO: 24726 - RNA, 20 nt, Artificial Sequence
  targeting sequence with TTCN PAM
cucuccaggccucaguuucc

SEQ ID NO: 24727 - RNA, 20 nt, Artificial Sequence
  targeting sequence with TTCN PAM
ccuagcacuuuacaguuuac

SEQ ID NO: 24728 - RNA, 20 nt, Artificial Sequence
  targeting sequence with TTCN PAM
cccauucgccuagcacuuua

SEQ ID NO: 24729 - RNA, 20 nt, Artificial Sequence
  targeting sequence with TTCN PAM
caagguagguaugguugggg

SEQ ID NO: 24730 - RNA, 20 nt, Artificial Sequence
  targeting sequence with TTCN PAM
ugggcacggucaacgggagg

SEQ ID NO: 24731 - RNA, 20 nt, Artificial Sequence
  targeting sequence with TTCN PAM
gcgccccgggccucaccucc

SEQ ID NO: 24732 - RNA, 20 nt, Artificial Sequence
  targeting sequence with TTCN PAM
ggggcugcaggauggacagc

SEQ ID NO: 24733 - RNA, 20 nt, Artificial Sequence
  targeting sequence with TTCN PAM
agcuccagccagagcagcug

SEQ ID NO: 24734 - RNA, 20 nt, Artificial Sequence
  targeting sequence with TTCN PAM
ucuuccagcuccagccagag

SEQ ID NO: 24735 - RNA, 20 nt, Artificial Sequence
  targeting sequence with TTCN PAM
ggagcugggaucugacgugc

SEQ ID NO: 24736 - RNA, 20 nt, Artificial Sequence
  targeting sequence with TTCN PAM
ccggcuccccgcccgcacag

SEQ ID NO: 24737 - RNA, 20 nt, Artificial Sequence
  targeting sequence with TTCN PAM
agucuuguuccuacuuuaua

SEQ ID NO: 24738 - RNA, 20 nt, Artificial Sequence
  targeting sequence with TTCN PAM
uacuuuauauccucagugcu

SEQ ID NO: 24739 - RNA, 20 nt, Artificial Sequence
  targeting sequence with TTCN PAM
aaggagaugauguucaaggu

SEQ ID NO: 24740 - RNA, 20 nt, Artificial Sequence
  targeting sequence with TTCN PAM
agguacacgggaaccagcag

SEQ ID NO: 24741 - RNA, 20 nt, Artificial Sequence
  targeting sequence with TTCN PAM
cguguaccuugaacaucauc

SEQ ID NO: 24742 - RNA, 20 nt, Artificial Sequence
  targeting sequence with TTCN PAM
cucgccugcugguucccgug

SEQ ID NO: 24743 - RNA, 20 nt, Artificial Sequence
  targeting sequence with TTCN PAM
cagcugugcccagccaggag

SEQ ID NO: 24744 - RNA, 20 nt, Artificial Sequence
  targeting sequence with TTCN PAM
uacagccccggcuggcucug

SEQ ID NO: 24745 - RNA, 20 nt, Artificial Sequence
  targeting sequence with TTCN PAM
uccugccgggugucugcucu

SEQ ID NO: 24746 - RNA, 20 nt, Artificial Sequence
  targeting sequence with TTCN PAM
uucccuccccaagcaccuau

SEQ ID NO: 24747 - RNA, 20 nt, Artificial Sequence
  targeting sequence with TTCN PAM
cuccccaagcaccuaucccc

SEQ ID NO: 24748 - RNA, 20 nt, Artificial Sequence
  targeting sequence with TTCN PAM
gacacacccagccuguuugu

SEQ ID NO: 24749 - RNA, 20 nt, Artificial Sequence
  targeting sequence with TTCN PAM
cugaacuugcuccuaccuuc

SEQ ID NO: 24750 - RNA, 20 nt, Artificial Sequence
  targeting sequence with TTCN PAM
gggaacagcccggacauggg

SEQ ID NO: 24751 - RNA, 20 nt, Artificial Sequence
  targeting sequence with TTCN PAM
cucccuucuccugggucuug

SEQ ID NO: 24752 - RNA, 20 nt, Artificial Sequence
  targeting sequence with TTCN PAM
ccugggucuugguauguuca

SEQ ID NO: 24753 - RNA, 20 nt, Artificial Sequence
  targeting sequence with TTCN PAM
aagguuccuggugcaauuug

SEQ ID NO: 24754 - RNA, 20 nt, Artificial Sequence
  targeting sequence with TTCN PAM
uggugcaauuugcacaaaaa

SEQ ID NO: 24755 - RNA, 20 nt, Artificial Sequence
  targeting sequence with TTCN PAM
auuuuugugcaaauugcacc

SEQ ID NO: 24756 - RNA, 20 nt, Artificial Sequence
  targeting sequence with TTCN PAM
uggaggccuguuuucuauuu

SEQ ID NO: 24757 - RNA, 20 nt, Artificial Sequence
  targeting sequence with TTCN PAM
cuccucugcaccacccuugu

SEQ ID NO: 24758 - RNA, 20 nt, Artificial Sequence
  targeting sequence with TTCN PAM
uguaaucagugugggcuuau

SEQ ID NO: 24759 - RNA, 20 nt, Artificial Sequence
  targeting sequence with TTCN PAM
caguaaauguggccuguuau

SEQ ID NO: 24760 - RNA, 20 nt, Artificial Sequence
  targeting sequence with TTCN PAM
gggagucagugcacuggccu

SEQ ID NO: 24761 - RNA, 20 nt, Artificial Sequence
  targeting sequence with TTCN PAM
ccaucugugagauaggaccc

SEQ ID NO: 24762 - RNA, 20 nt, Artificial Sequence
  targeting sequence with TTCN PAM
ccucugagccucaguuuccc

SEQ ID NO: 24763 - RNA, 20 nt, Artificial Sequence
  targeting sequence with TTCN PAM
ggugaccucccugaguccug

SEQ ID NO: 24764 - RNA, 20 nt, Artificial Sequence
  targeting sequence with TTCN PAM
aaugcugccuuccggugacc

SEQ ID NO: 24765 - RNA, 20 nt, Artificial Sequence
  targeting sequence with TTCN PAM
ccucugagccucauuuuacu

SEQ ID NO: 24766 - RNA, 20 nt, Artificial Sequence
  targeting sequence with TTCN PAM
gcauagaggcugggaugaau

SEQ ID NO: 24767 - RNA, 20 nt, Artificial Sequence
  targeting sequence with TTCN PAM
ucccagccucuaugcggaaa

SEQ ID NO: 24768 - RNA, 20 nt, Artificial Sequence
  targeting sequence with TTCN PAM
caaacgccgggcgugguggc

SEQ ID NO: 24769 - RNA, 20 nt, Artificial Sequence
  targeting sequence with TTCN PAM
cagcuacuugggaggcugag

SEQ ID NO: 24770 - RNA, 20 nt, Artificial Sequence
  targeting sequence with TTCN PAM
aggcuguagugugcuaugcu

SEQ ID NO: 24771 - RNA, 20 nt, Artificial Sequence
  targeting sequence with TTCN PAM
gcaucaauauggugaccucc

SEQ ID NO: 24772 - RNA, 20 nt, Artificial Sequence
  targeting sequence with TTCN PAM
ccccuccuuaggcaaccugg

SEQ ID NO: 24773 - RNA, 20 nt, Artificial Sequence
  targeting sequence with TTCN PAM
gaccugggccaguucacccc

SEQ ID NO: 24774 - RNA, 20 nt, Artificial Sequence
  targeting sequence with TTCN PAM
uacaguaccuggcccacagu

SEQ ID NO: 24775 - RNA, 20 nt, Artificial Sequence
  targeting sequence with TTCN PAM
uggacacuuacugugggcca

SEQ ID NO: 24776 - RNA, 20 nt, Artificial Sequence
  targeting sequence with TTCN PAM
gacaugacugcugcuuaugu

SEQ ID NO: 24777 - RNA, 20 nt, Artificial Sequence
  targeting sequence with TTCN PAM
uaauaauaacauaagcagca

SEQ ID NO: 24778 - RNA, 20 nt, Artificial Sequence
  targeting sequence with TTCN PAM
acugcugaucaaaaaagaaa

SEQ ID NO: 24779 - RNA, 20 nt, Artificial Sequence
  targeting sequence with TTCN PAM
uuuuugaucagcaguugaac

SEQ ID NO: 24780 - RNA, 20 nt, Artificial Sequence
  targeting sequence with TTCN PAM
uucuuuuuugaucagcaguu

SEQ ID NO: 24781 - RNA, 20 nt, Artificial Sequence
  targeting sequence with TTCN PAM
uucuuucuuuuuugaucagc

SEQ ID NO: 24782 - RNA, 20 nt, Artificial Sequence
  targeting sequence with TTCN PAM
gggcaaaucaugccuaccuu

SEQ ID NO: 24783 - RNA, 20 nt, Artificial Sequence
  targeting sequence with TTCN PAM
uuuuccaagaccacucuugc

SEQ ID NO: 24784 - RNA, 20 nt, Artificial Sequence
  targeting sequence with TTCN PAM
aagaccacucuugcccccua

SEQ ID NO: 24785 - RNA, 20 nt, Artificial Sequence
  targeting sequence with TTCN PAM
uaucugcuaacacagcugcc

SEQ ID NO: 24786 - RNA, 20 nt, Artificial Sequence
  targeting sequence with TTCN PAM
agcccucccaugguuuccag

SEQ ID NO: 24787 - RNA, 20 nt, Artificial Sequence
  targeting sequence with TTCN PAM
aggacacucagaauaaaucc

SEQ ID NO: 24788 - RNA, 20 nt, Artificial Sequence
  targeting sequence with TTCN PAM
gaguguccuggaaaccaugg

SEQ ID NO: 24789 - RNA, 20 nt, Artificial Sequence
  targeting sequence with TTCN PAM
ggauuuauucugaguguccu

SEQ ID NO: 24790 - RNA, 20 nt, Artificial Sequence
  targeting sequence with TTCN PAM
aacuccauuucacaccuccc

SEQ ID NO: 24791 - RNA, 20 nt, Artificial Sequence
  targeting sequence with TTCN PAM
caccucccuugcccuugcuc

SEQ ID NO: 24792 - RNA, 20 nt, Artificial Sequence
  targeting sequence with TTCN PAM
ccccagccacacuggccuca

SEQ ID NO: 24793 - RNA, 20 nt, Artificial Sequence
  targeting sequence with TTCN PAM
gugccucaaauaucacaagc

SEQ ID NO: 24794 - RNA, 20 nt, Artificial Sequence
  targeting sequence with TTCN PAM
ugccucaggaccucuggccu

SEQ ID NO: 24795 - RNA, 20 nt, Artificial Sequence
  targeting sequence with TTCN PAM
ugggcagagggagcggccag

SEQ ID NO: 24796 - RNA, 20 nt, Artificial Sequence
  targeting sequence with TTCN PAM
cccccacccgagagcugcau

SEQ ID NO: 24797 - RNA, 20 nt, Artificial Sequence
  targeting sequence with TTCN PAM
agggcuguccccaacuguaa

SEQ ID NO: 24798 - RNA, 20 nt, Artificial Sequence
  targeting sequence with TTCN PAM
cugcagcugcaggauugcug

SEQ ID NO: 24799 - RNA, 20 nt, Artificial Sequence
  targeting sequence with TTCN PAM
uaggggcuagguaacuaagu

SEQ ID NO: 24800 - RNA, 20 nt, Artificial Sequence
  targeting sequence with TTCN PAM
cugaauaugaauuacuugca

SEQ ID NO: 24801 - RNA, 20 nt, Artificial Sequence
  targeting sequence with TTCN PAM
gugaaaaaaguuacuuaguu

SEQ ID NO: 24802 - RNA, 20 nt, Artificial Sequence
  targeting sequence with TTCN PAM
uauucagugaaaaaaguuac

SEQ ID NO: 24803 - RNA, 20 nt, Artificial Sequence
  targeting sequence with TTCN PAM
caauuuuaauuuuaaacaac

SEQ ID NO: 24804 - RNA, 20 nt, Artificial Sequence
  targeting sequence with TTCN PAM
cuuggugggagggauucaca

SEQ ID NO: 24805 - RNA, 20 nt, Artificial Sequence
  targeting sequence with TTCN PAM
ggaaggggacaccugggagg

SEQ ID NO: 24806 - RNA, 20 nt, Artificial Sequence
  targeting sequence with TTCN PAM
agaacuuauguucccuuggu

SEQ ID NO: 24807 - RNA, 20 nt, Artificial Sequence
  targeting sequence with TTCN PAM
caggaccccacccuggcugg

SEQ ID NO: 24808 - RNA, 20 nt, Artificial Sequence
  targeting sequence with TTCN PAM
caagccauuaauucugcacc

SEQ ID NO: 24809 - RNA, 20 nt, Artificial Sequence
  targeting sequence with TTCN PAM
gcaccgaaggaauuuucuaa

SEQ ID NO: 24810 - RNA, 20 nt, Artificial Sequence
  targeting sequence with TTCN PAM
gugcagaauuaauggcuugu

SEQ ID NO: 24811 - RNA, 20 nt, Artificial Sequence
  targeting sequence with TTCN PAM
uucggugcagaauuaauggc

SEQ ID NO: 24812 - RNA, 20 nt, Artificial Sequence
  targeting sequence with TTCN PAM
aaaaggccuuucccccagcg

SEQ ID NO: 24813 - RNA, 20 nt, Artificial Sequence
  targeting sequence with TTCN PAM
cccagcguuuuuuccccuua

SEQ ID NO: 24814 - RNA, 20 nt, Artificial Sequence
  targeting sequence with TTCN PAM
ccuuauccuaaaauaaaauu

SEQ ID NO: 24815 - RNA, 20 nt, Artificial Sequence
  targeting sequence with TTCN PAM
uuaaaaaaauuuuuuaaaau

SEQ ID NO: 24816 - RNA, 20 nt, Artificial Sequence
  targeting sequence with TTCN PAM
gagcagccgacggcuuacuu

SEQ ID NO: 24817 - RNA, 20 nt, Artificial Sequence
  targeting sequence with TTCN PAM
gagggggaagcugauucccc

SEQ ID NO: 24818 - RNA, 20 nt, Artificial Sequence
  targeting sequence with TTCN PAM
cccucggaacacagaucauu

SEQ ID NO: 24819 - RNA, 20 nt, Artificial Sequence
  targeting sequence with TTCN PAM
ccagcugccaggggaaauca

SEQ ID NO: 24820 - RNA, 20 nt, Artificial Sequence
  targeting sequence with TTCN PAM
ccuggcagcuggggaaucag

SEQ ID NO: 24821 - RNA, 20 nt, Artificial Sequence
  targeting sequence with TTCN PAM
guguuugagccgguuugccu

SEQ ID NO: 24822 - RNA, 20 nt, Artificial Sequence
  targeting sequence with TTCN PAM
cgccacgcugggcuuccgug

SEQ ID NO: 24823 - RNA, 20 nt, Artificial Sequence
  targeting sequence with TTCN PAM
gccgaggccagcaugcucag

SEQ ID NO: 24824 - RNA, 20 nt, Artificial Sequence
  targeting sequence with TTCN PAM
aaacucaaguucuccugaga

SEQ ID NO: 24825 - RNA, 20 nt, Artificial Sequence
  targeting sequence with TTCN PAM
ccugagagcagggaaggcuc

SEQ ID NO: 24826 - RNA, 20 nt, Artificial Sequence
  targeting sequence with TTCN PAM
cugcucucaggagaacuuga

SEQ ID NO: 24827 - RNA, 20 nt, Artificial Sequence
  targeting sequence with TTCN PAM
cucacacaaagcuggucaga

SEQ ID NO: 24828 - RNA, 20 nt, Artificial Sequence
  targeting sequence with TTCN PAM
aggccuucgugccccagcuc

SEQ ID NO: 24829 - RNA, 20 nt, Artificial Sequence
  targeting sequence with TTCN PAM
ugccccagcuccugccagcu

SEQ ID NO: 24830 - RNA, 20 nt, Artificial Sequence
  targeting sequence with TTCN PAM
aggaccuguggagacugaug

SEQ ID NO: 24831 - RNA, 20 nt, Artificial Sequence
  targeting sequence with TTCN PAM
gcagccaaugcccaucccau

SEQ ID NO: 24832 - RNA, 20 nt, Artificial Sequence
  targeting sequence with TTCN PAM
uacuccccuuggcacuucag

SEQ ID NO: 24833 - RNA, 20 nt, Artificial Sequence
  targeting sequence with TTCN PAM
gcgcccccggugucuggacc

SEQ ID NO: 24834 - RNA, 20 nt, Artificial Sequence
  targeting sequence with TTCN PAM
cucuccaggcaugcccagac

SEQ ID NO: 24835 - RNA, 20 nt, Artificial Sequence
  targeting sequence with TTCN PAM
agauguggcucagcccccca

SEQ ID NO: 24836 - RNA, 20 nt, Artificial Sequence
  targeting sequence with TTCN PAM
cauggcagcacaugcaugac

SEQ ID NO: 24837 - RNA, 20 nt, Artificial Sequence
  targeting sequence with TTCN PAM
ccagcauggagccugugcuc

SEQ ID NO: 24838 - RNA, 20 nt, Artificial Sequence
  targeting sequence with TTCN PAM
cuccagagcacaggcuccau

SEQ ID NO: 24839 - RNA, 20 nt, Artificial Sequence
  targeting sequence with TTCN PAM
uuuguaaacauucccuccag

SEQ ID NO: 24840 - RNA, 20 nt, Artificial Sequence
  targeting sequence with TTCN PAM
uuucuuuuguaaacauuccc

SEQ ID NO: 24841 - RNA, 20 nt, Artificial Sequence
  targeting sequence with TTCN PAM
cacuuuagucaaaauuaggu

SEQ ID NO: 24842 - RNA, 20 nt, Artificial Sequence
  targeting sequence with TTCN PAM
cucuaagucgagugacugag

SEQ ID NO: 24843 - RNA, 20 nt, Artificial Sequence
  targeting sequence with TTCN PAM
ccagcacccagcauggccgu

SEQ ID NO: 24844 - RNA, 20 nt, Artificial Sequence
  targeting sequence with TTCN PAM
cucaguucuccagcacccag

SEQ ID NO: 24845 - RNA, 20 nt, Artificial Sequence
  targeting sequence with TTCN PAM
ggcccaggcaacacuggcug

SEQ ID NO: 24846 - RNA, 20 nt, Artificial Sequence
  targeting sequence with TTCN PAM
guuccuguaaaaaccucacu

SEQ ID NO: 24847 - RNA, 20 nt, Artificial Sequence
  targeting sequence with TTCN PAM
uguaaaaaccucacuuuauc

SEQ ID NO: 24848 - RNA, 20 nt, Artificial Sequence
  targeting sequence with TTCN PAM
gccccguuuugagagcagga

SEQ ID NO: 24849 - RNA, 20 nt, Artificial Sequence
  targeting sequence with TTCN PAM
cuccccaggaagccaguugg

SEQ ID NO: 24850 - RNA, 20 nt, Artificial Sequence
  targeting sequence with TTCN PAM
uggggagagaaagucaacac

SEQ ID NO: 24851 - RNA, 20 nt, Artificial Sequence
  targeting sequence with TTCN PAM
aacuggcuuccuggggagag

SEQ ID NO: 24852 - RNA, 20 nt, Artificial Sequence
  targeting sequence with TTCN PAM
agagcccggcuucucaggcc

SEQ ID NO: 24853 - RNA, 20 nt, Artificial Sequence
  targeting sequence with TTCN PAM
caggccucacauccugccgc

SEQ ID NO: 24854 - RNA, 20 nt, Artificial Sequence
  targeting sequence with TTCN PAM
uagugccaccugcggugggu

SEQ ID NO: 24855 - RNA, 20 nt, Artificial Sequence
  targeting sequence with TTCN PAM
gucacagguacagacugcau

SEQ ID NO: 24856 - RNA, 20 nt, Artificial Sequence
  targeting sequence with TTCN PAM
caagugcaaagccuccgcag

SEQ ID NO: 24857 - RNA, 20 nt, Artificial Sequence
  targeting sequence with TTCN PAM
ugccugaaguguuugauugu

SEQ ID NO: 24858 - RNA, 20 nt, Artificial Sequence
  targeting sequence with TTCN PAM
ggcaggaaggugcccucacu

SEQ ID NO: 24859 - RNA, 20 nt, Artificial Sequence
  targeting sequence with TTCN PAM
caggaucauaaacaaucaaa

SEQ ID NO: 24860 - RNA, 20 nt, Artificial Sequence
  targeting sequence with TTCN PAM
uugccacagagcugaaauuu

SEQ ID NO: 24861 - RNA, 20 nt, Artificial Sequence
  targeting sequence with TTCN PAM
gcucuguggcaaggaaaccu

SEQ ID NO: 24862 - RNA, 20 nt, Artificial Sequence
  targeting sequence with TTCN PAM
gcucuguggcaaauuucagc

SEQ ID NO: 24863 - RNA, 20 nt, Artificial Sequence
  targeting sequence with TTCN PAM
caccauggcucacgccugua

SEQ ID NO: 24864 - RNA, 20 nt, Artificial Sequence
  targeting sequence with TTCN PAM
acguccaccucccaaagcgc

SEQ ID NO: 24865 - RNA, 20 nt, Artificial Sequence
  targeting sequence with TTCN PAM
ggcgauccuuccacguccac

SEQ ID NO: 24866 - RNA, 20 nt, Artificial Sequence
  targeting sequence with TTCN PAM
ccaccgcacuccagucuggg

SEQ ID NO: 24867 - RNA, 20 nt, Artificial Sequence
  targeting sequence with TTCN PAM
agacagggucucugucaccc

SEQ ID NO: 24868 - RNA, 20 nt, Artificial Sequence
  targeting sequence with TTCN PAM
cauucauccuucacgggagc

SEQ ID NO: 24869 - RNA, 20 nt, Artificial Sequence
  targeting sequence with TTCN PAM
uccuucacgggagccaaaga

SEQ ID NO: 24870 - RNA, 20 nt, Artificial Sequence
  targeting sequence with TTCN PAM
cgggagccaaagagagcuuu

SEQ ID NO: 24871 - RNA, 20 nt, Artificial Sequence
  targeting sequence with TTCN PAM
aggagcccauguugcauuaa

SEQ ID NO: 24872 - RNA, 20 nt, Artificial Sequence
  targeting sequence with TTCN PAM
uuuccaggagcccauguugc

SEQ ID NO: 24873 - RNA, 20 nt, Artificial Sequence
  targeting sequence with TTCN PAM
uuacucccaacuaaacucca

SEQ ID NO: 24874 - RNA, 20 nt, Artificial Sequence
  targeting sequence with TTCN PAM
uaguuuugacaaauguacca

SEQ ID NO: 24875 - RNA, 20 nt, Artificial Sequence
  targeting sequence with TTCN PAM
cccauugcuaacaucuuacc

SEQ ID NO: 24876 - RNA, 20 nt, Artificial Sequence
  targeting sequence with TTCN PAM
uguauacccguccccuaguu

SEQ ID NO: 24877 - RNA, 20 nt, Artificial Sequence
  targeting sequence with TTCN PAM
ugaaaaucuaaaauuauucc

SEQ ID NO: 24878 - RNA, 20 nt, Artificial Sequence
  targeting sequence with TTCN PAM
ggaaaguuacaaagauagua

SEQ ID NO: 24879 - RNA, 20 nt, Artificial Sequence
  targeting sequence with TTCN PAM
aaaguaaaaaguuuauuuug

SEQ ID NO: 24880 - RNA, 20 nt, Artificial Sequence
  targeting sequence with TTCN PAM
caugguucccuagugcuguc

SEQ ID NO: 24881 - RNA, 20 nt, Artificial Sequence
  targeting sequence with TTCN PAM
cuagugcugucaacacaaac

SEQ ID NO: 24882 - RNA, 20 nt, Artificial Sequence
  targeting sequence with TTCN PAM
agggcccaggagcaaaguuu

SEQ ID NO: 24883 - RNA, 20 nt, Artificial Sequence
  targeting sequence with TTCN PAM
uacccuggccuggcugugug

SEQ ID NO: 24884 - RNA, 20 nt, Artificial Sequence
  targeting sequence with TTCN PAM
acuucagcaugcacugccuc

SEQ ID NO: 24885 - RNA, 20 nt, Artificial Sequence
  targeting sequence with TTCN PAM
gcaugcacugccucucagaa

SEQ ID NO: 24886 - RNA, 20 nt, Artificial Sequence
  targeting sequence with TTCN PAM
gagaggcagugcaugcugaa

SEQ ID NO: 24887 - RNA, 20 nt, Artificial Sequence
  targeting sequence with TTCN PAM
uugccucaguuuacucucag

SEQ ID NO: 24888 - RNA, 20 nt, Artificial Sequence
  targeting sequence with TTCN PAM
cagcagcagguggucuccuc

SEQ ID NO: 24889 - RNA, 20 nt, Artificial Sequence
  targeting sequence with TTCN PAM
ggggugaccaagaggcuucc

SEQ ID NO: 24890 - RNA, 20 nt, Artificial Sequence
  targeting sequence with TTCN PAM
uggaggggcuguagggagaa

SEQ ID NO: 24891 - RNA, 20 nt, Artificial Sequence
  targeting sequence with TTCN PAM
cccuacagccccuccaggaa

SEQ ID NO: 24892 - RNA, 20 nt, Artificial Sequence
  targeting sequence with TTCN PAM
ugaccauggugcuaggccug

SEQ ID NO: 24893 - RNA, 20 nt, Artificial Sequence
  targeting sequence with TTCN PAM
ucuguggcuaaggccaggcu

SEQ ID NO: 24894 - RNA, 20 nt, Artificial Sequence
  targeting sequence with TTCN PAM
ccaacgugcuccuccaggcu

SEQ ID NO: 24895 - RNA, 20 nt, Artificial Sequence
  targeting sequence with TTCN PAM
cugugccuugguuucuccaa

SEQ ID NO: 24896 - RNA, 20 nt, Artificial Sequence
  targeting sequence with TTCN PAM
gacaaacggcaaaggacaca

SEQ ID NO: 24897 - RNA, 20 nt, Artificial Sequence
  targeting sequence with TTCN PAM
gggaggccugccuugguuuc

SEQ ID NO: 24898 - RNA, 20 nt, Artificial Sequence
  targeting sequence with TTCN PAM
cugaccccucuggaagaggc

SEQ ID NO: 24899 - RNA, 20 nt, Artificial Sequence
  targeting sequence with TTCN PAM
agaggggucagggaaaccaa

SEQ ID NO: 24900 - RNA, 20 nt, Artificial Sequence
  targeting sequence with TTCN PAM
agaugguguccagcuggucu

SEQ ID NO: 24901 - RNA, 20 nt, Artificial Sequence
  targeting sequence with TTCN PAM
gcccuuccagauggugucca

SEQ ID NO: 24902 - RNA, 20 nt, Artificial Sequence
  targeting sequence with TTCN PAM
aggccaugccuguuuggggu

SEQ ID NO: 24903 - RNA, 20 nt, Artificial Sequence
  targeting sequence with TTCN PAM
caucuguaaaauggguacgc

SEQ ID NO: 24904 - RNA, 20 nt, Artificial Sequence
  targeting sequence with TTCN PAM
gaggggauggugccucccau

SEQ ID NO: 24905 - RNA, 20 nt, Artificial Sequence
  targeting sequence with TTCN PAM
auaagcccuagguggugggu

SEQ ID NO: 24906 - RNA, 20 nt, Artificial Sequence
  targeting sequence with TTCN PAM
gugcuaagcacuguaggugc

SEQ ID NO: 24907 - RNA, 20 nt, Artificial Sequence
  targeting sequence with TTCN PAM
caauuagcuaugcagaccac

SEQ ID NO: 24908 - RNA, 20 nt, Artificial Sequence
  targeting sequence with TTCN PAM
ugaagucaaagcauccgagg

SEQ ID NO: 24909 - RNA, 20 nt, Artificial Sequence
  targeting sequence with TTCN PAM
ggaagcgguggaguggcuug

SEQ ID NO: 24910 - RNA, 20 nt, Artificial Sequence
  targeting sequence with TTCN PAM
caggcgccagggcagagcag

SEQ ID NO: 24911 - RNA, 20 nt, Artificial Sequence
  targeting sequence with TTCN PAM
ugaagcuguuucucauuccg

SEQ ID NO: 24912 - RNA, 20 nt, Artificial Sequence
  targeting sequence with TTCN PAM
ugaagggggagcuggguguc

SEQ ID NO: 24913 - RNA, 20 nt, Artificial Sequence
  targeting sequence with TTCN PAM
cauuccggcccggccuggcc

SEQ ID NO: 24914 - RNA, 20 nt, Artificial Sequence
  targeting sequence with TTCN PAM
ggcccggccuggccccauuu

SEQ ID NO: 24915 - RNA, 20 nt, Artificial Sequence
  targeting sequence with TTCN PAM
agcuccccucccccuggguc

SEQ ID NO: 24916 - RNA, 20 nt, Artificial Sequence
  targeting sequence with TTCN PAM
cuggcccagggaaaaggcuu

SEQ ID NO: 24917 - RNA, 20 nt, Artificial Sequence
  targeting sequence with TTCN PAM
cugggccagggaagagccgc

SEQ ID NO: 24918 - RNA, 20 nt, Artificial Sequence
  targeting sequence with TTCN PAM
cuccccccagcaggaggggc

SEQ ID NO: 24919 - RNA, 20 nt, Artificial Sequence
  targeting sequence with TTCN PAM
ugcucugccccuccugcugg

SEQ ID NO: 24920 - RNA, 20 nt, Artificial Sequence
  targeting sequence with TTCN PAM
aagcccuggaacaguuuccc

SEQ ID NO: 24921 - RNA, 20 nt, Artificial Sequence
  targeting sequence with TTCN PAM
agggcuuggaaagacuggcu

SEQ ID NO: 24922 - RNA, 20 nt, Artificial Sequence
  targeting sequence with TTCN PAM
cucccagcuuccuccccuga

SEQ ID NO: 24923 - RNA, 20 nt, Artificial Sequence
  targeting sequence with TTCN PAM
uccccugaagggacuccagg

SEQ ID NO: 24924 - RNA, 20 nt, Artificial Sequence
  targeting sequence with TTCN PAM
ggggaggaagcugggaggga

SEQ ID NO: 24925 - RNA, 20 nt, Artificial Sequence
  targeting sequence with TTCN PAM
cggcuccuggccuggagucc

SEQ ID NO: 24926 - RNA, 20 nt, Artificial Sequence
  targeting sequence with TTCN PAM
cuggagaggcaacuauuucu

SEQ ID NO: 24927 - RNA, 20 nt, Artificial Sequence
  targeting sequence with TTCN PAM
cuccuggggcuggggggacu

SEQ ID NO: 24928 - RNA, 20 nt, Artificial Sequence
  targeting sequence with TTCN PAM
aucucacacccuccucccca

SEQ ID NO: 24929 - RNA, 20 nt, Artificial Sequence
  targeting sequence with TTCN PAM
uggcuguguccacagcgguc

SEQ ID NO: 24930 - RNA, 20 nt, Artificial Sequence
  targeting sequence with TTCN PAM
augagcuggggacacagagg

SEQ ID NO: 24931 - RNA, 20 nt, Artificial Sequence
  targeting sequence with TTCN PAM
cauaguaacaguucgguaga

SEQ ID NO: 24932 - RNA, 20 nt, Artificial Sequence
  targeting sequence with TTCN PAM
guagagugacaguagcaagc

SEQ ID NO: 24933 - RNA, 20 nt, Artificial Sequence
  targeting sequence with TTCN PAM
guauuaucucauucaacccu

SEQ ID NO: 24934 - RNA, 20 nt, Artificial Sequence
  targeting sequence with TTCN PAM
acccucaccacacccugaaa

SEQ ID NO: 24935 - RNA, 20 nt, Artificial Sequence
  targeting sequence with TTCN PAM
ggguguggugaggguugaau

SEQ ID NO: 24936 - RNA, 20 nt, Artificial Sequence
  targeting sequence with TTCN PAM
uuuacuguaaagcagcauca

SEQ ID NO: 24937 - RNA, 20 nt, Artificial Sequence
  targeting sequence with TTCN PAM
acucucugugccucaguuuc

SEQ ID NO: 24938 - RNA, 20 nt, Artificial Sequence
  targeting sequence with TTCN PAM
ggcugugugccccugggcaa

SEQ ID NO: 24939 - RNA, 20 nt, Artificial Sequence
  targeting sequence with TTCN PAM
uggcaaccauugguggcucc

SEQ ID NO: 24940 - RNA, 20 nt, Artificial Sequence
  targeting sequence with TTCN PAM
agcuccaagcggcugauuuc

SEQ ID NO: 24941 - RNA, 20 nt, Artificial Sequence
  targeting sequence with TTCN PAM
ccagcucaaaacccaggguu

SEQ ID NO: 24942 - RNA, 20 nt, Artificial Sequence
  targeting sequence with TTCN PAM
agagagcucagucaccucaa

SEQ ID NO: 24943 - RNA, 20 nt, Artificial Sequence
  targeting sequence with TTCN PAM
ccagccucugcccgcuaucu

SEQ ID NO: 24944 - RNA, 20 nt, Artificial Sequence
  targeting sequence with TTCN PAM
ugggccuggccuccacucca

SEQ ID NO: 24945 - RNA, 20 nt, Artificial Sequence
  targeting sequence with TTCN PAM
cucccccuccagcgcaugau

SEQ ID NO: 24946 - RNA, 20 nt, Artificial Sequence
  targeting sequence with TTCN PAM
ggguaaaggacgguggacua

SEQ ID NO: 24947 - RNA, 20 nt, Artificial Sequence
  targeting sequence with TTCN PAM
gcccuggcucagacauggcc

SEQ ID NO: 24948 - RNA, 20 nt, Artificial Sequence
  targeting sequence with TTCN PAM
aaaggccaugucugagccag

SEQ ID NO: 24949 - RNA, 20 nt, Artificial Sequence
  targeting sequence with TTCN PAM
uuccaaaggccaugucugag

SEQ ID NO: 24950 - RNA, 20 nt, Artificial Sequence
  targeting sequence with TTCN PAM
ucuuuccaaaggccaugucu

SEQ ID NO: 24951 - RNA, 20 nt, Artificial Sequence
  targeting sequence with TTCN PAM
gggcuuguccccacucggga

SEQ ID NO: 24952 - RNA, 20 nt, Artificial Sequence
  targeting sequence with TTCN PAM
cgaguggggacaagcccaga

SEQ ID NO: 24953 - RNA, 20 nt, Artificial Sequence
  targeting sequence with TTCN PAM
auggcaauccccacauggcu

SEQ ID NO: 24954 - RNA, 20 nt, Artificial Sequence
  targeting sequence with TTCN PAM
ggaaccagaucagccauguc

SEQ ID NO: 24955 - RNA, 20 nt, Artificial Sequence
  targeting sequence with TTCN PAM
ggaagggacccuguggcugc

SEQ ID NO: 24956 - RNA, 20 nt, Artificial Sequence
  targeting sequence with TTCN PAM
ccaaagcccugcuggcuccc

SEQ ID NO: 24957 - RNA, 20 nt, Artificial Sequence
  targeting sequence with TTCN PAM
ccucggccugcuacccaagc

SEQ ID NO: 24958 - RNA, 20 nt, Artificial Sequence
  targeting sequence with TTCN PAM
aacaucucugagccuuugcc

SEQ ID NO: 24959 - RNA, 20 nt, Artificial Sequence
  targeting sequence with TTCN PAM
aggcagagcacacgauaggg

SEQ ID NO: 24960 - RNA, 20 nt, Artificial Sequence
  targeting sequence with TTCN PAM
ccagccccaucugucaagug

SEQ ID NO: 24961 - RNA, 20 nt, Artificial Sequence
  targeting sequence with TTCN PAM
uggaggaggggagguuggag

SEQ ID NO: 24962 - RNA, 20 nt, Artificial Sequence
  targeting sequence with TTCN PAM
gggggcuccuggagaggguc

SEQ ID NO: 24963 - RNA, 20 nt, Artificial Sequence
  targeting sequence with TTCN PAM
ggguggccugcagagcugcc

SEQ ID NO: 24964 - RNA, 20 nt, Artificial Sequence
  targeting sequence with TTCN PAM
cacaggggccucggcggacg

SEQ ID NO: 24965 - RNA, 20 nt, Artificial Sequence
  targeting sequence with TTCN PAM
gcguccgccgaggccccugu

SEQ ID NO: 24966 - RNA, 20 nt, Artificial Sequence
  targeting sequence with TTCN PAM
cugggucucaguuuccucac

SEQ ID NO: 24967 - RNA, 20 nt, Artificial Sequence
  targeting sequence with TTCN PAM
ucaccuuuaaaaugggccca

SEQ ID NO: 24968 - RNA, 20 nt, Artificial Sequence
  targeting sequence with TTCN PAM
ccccuuccgacacccucugg

SEQ ID NO: 24969 - RNA, 20 nt, Artificial Sequence
  targeting sequence with TTCN PAM
gacacccucuggcucacacc

SEQ ID NO: 24970 - RNA, 20 nt, Artificial Sequence
  targeting sequence with TTCN PAM
gucaaagauuuuggaggaau

SEQ ID NO: 24971 - RNA, 20 nt, Artificial Sequence
  targeting sequence with TTCN PAM
uccaaaaucuuugaccgaag

SEQ ID NO: 24972 - RNA, 20 nt, Artificial Sequence
  targeting sequence with TTCN PAM
ggcuguagcgccugugaccc

SEQ ID NO: 24973 - RNA, 20 nt, Artificial Sequence
  targeting sequence with TTCN PAM
ggaccucuguuuccccuucc

SEQ ID NO: 24974 - RNA, 20 nt, Artificial Sequence
  targeting sequence with TTCN PAM
ccuuccauagacuggggaua

SEQ ID NO: 24975 - RNA, 20 nt, Artificial Sequence
  targeting sequence with TTCN PAM
auagacuggggauaacaguc

SEQ ID NO: 24976 - RNA, 20 nt, Artificial Sequence
  targeting sequence with TTCN PAM
gguucuggggagauuaaaag

SEQ ID NO: 24977 - RNA, 20 nt, Artificial Sequence
  targeting sequence with TTCN PAM
ggggagauuaaaagauaugu

SEQ ID NO: 24978 - RNA, 20 nt, Artificial Sequence
  targeting sequence with TTCN PAM
cuguguuagcccuuugcaga

SEQ ID NO: 24979 - RNA, 20 nt, Artificial Sequence
  targeting sequence with TTCN PAM
caagcaacaaccacaguaau

SEQ ID NO: 24980 - RNA, 20 nt, Artificial Sequence
  targeting sequence with TTCN PAM
ggugucagagggaaggcuuc

SEQ ID NO: 24981 - RNA, 20 nt, Artificial Sequence
  targeting sequence with TTCN PAM
cucugacaccagaacugccc

SEQ ID NO: 24982 - RNA, 20 nt, Artificial Sequence
  targeting sequence with TTCN PAM
uugccacuccaugggccaac

SEQ ID NO: 24983 - RNA, 20 nt, Artificial Sequence
  targeting sequence with TTCN PAM
ccgacccuggaguuggccca

SEQ ID NO: 24984 - RNA, 20 nt, Artificial Sequence
  targeting sequence with TTCN PAM
ccuaccugggccuccguucu

SEQ ID NO: 24985 - RNA, 20 nt, Artificial Sequence
  targeting sequence with TTCN PAM
cggcagcaaccaggacaugg

SEQ ID NO: 24986 - RNA, 20 nt, Artificial Sequence
  targeting sequence with TTCN PAM
auguccugguugcugccgug

SEQ ID NO: 24987 - RNA, 20 nt, Artificial Sequence
  targeting sequence with TTCN PAM
uuaaucuccauggagaccgg

SEQ ID NO: 24988 - RNA, 20 nt, Artificial Sequence
  targeting sequence with TTCN PAM
cccgccugugacucccgguc

SEQ ID NO: 24989 - RNA, 20 nt, Artificial Sequence
  targeting sequence with TTCN PAM
gccgggcccgaugcgcgugg

SEQ ID NO: 24990 - RNA, 20 nt, Artificial Sequence
  targeting sequence with TTCN PAM
gcaagggccacgcgcaucgg

SEQ ID NO: 24991 - RNA, 20 nt, Artificial Sequence
  targeting sequence with TTCN PAM
cugcgcucagcccacuuuau

SEQ ID NO: 24992 - RNA, 20 nt, Artificial Sequence
  targeting sequence with TTCN PAM
caucuauaaagugggcugag

SEQ ID NO: 24993 - RNA, 20 nt, Artificial Sequence
  targeting sequence with TTCN PAM
uggagccuccauuuucccau

SEQ ID NO: 24994 - RNA, 20 nt, Artificial Sequence
  targeting sequence with TTCN PAM
acagcuaggaaggggcagag

SEQ ID NO: 24995 - RNA, 20 nt, Artificial Sequence
  targeting sequence with TTCN PAM
uagcuguggaaagucccauc

SEQ ID NO: 24996 - RNA, 20 nt, Artificial Sequence
  targeting sequence with TTCN PAM
aauccugccucugccccuuc

SEQ ID NO: 24997 - RNA, 20 nt, Artificial Sequence
  targeting sequence with TTCN PAM
cagauucaaauccugccucu

SEQ ID NO: 24998 - RNA, 20 nt, Artificial Sequence
  targeting sequence with TTCN PAM
acagccaggcaggcgcacau

SEQ ID NO: 24999 - RNA, 20 nt, Artificial Sequence
  targeting sequence with TTCN PAM
cacugaccauugaacccaca

SEQ ID NO: 25000 - RNA, 20 nt, Artificial Sequence
  targeting sequence with TTCN PAM
auggucagugugaaugaugg

SEQ ID NO: 25001 - RNA, 20 nt, Artificial Sequence
  targeting sequence with TTCN PAM
agaggcugaugaucgcauuu

SEQ ID NO: 25002 - RNA, 20 nt, Artificial Sequence
  targeting sequence with TTCN PAM
gacaaaugcaacuagaaguu

SEQ ID NO: 25003 - RNA, 20 nt, Artificial Sequence
  targeting sequence with TTCN PAM
aguugcauuugucugaaaau

SEQ ID NO: 25004 - RNA, 20 nt, Artificial Sequence
  targeting sequence with TTCN PAM
uugccuccccugacuuccuc

SEQ ID NO: 25005 - RNA, 20 nt, Artificial Sequence
  targeting sequence with TTCN PAM
ucaggaagcugggucagccc

SEQ ID NO: 25006 - RNA, 20 nt, Artificial Sequence
  targeting sequence with TTCN PAM
ugaggaagucaggggaggca

SEQ ID NO: 25007 - RNA, 20 nt, Artificial Sequence
  targeting sequence with TTCN PAM
ggcagggcccauugugauag

SEQ ID NO: 25008 - RNA, 20 nt, Artificial Sequence
  targeting sequence with TTCN PAM
cccucuggcugggccauaga

SEQ ID NO: 25009 - RNA, 20 nt, Artificial Sequence
  targeting sequence with TTCN PAM
gcaguucccccucuggcugg

SEQ ID NO: 25010 - RNA, 20 nt, Artificial Sequence
  targeting sequence with TTCN PAM
ccaccacggagagcucacag

SEQ ID NO: 25011 - RNA, 20 nt, Artificial Sequence
  targeting sequence with TTCN PAM
ugguggcuggugagcuguga

SEQ ID NO: 25012 - RNA, 20 nt, Artificial Sequence
  targeting sequence with TTCN PAM
aucugcggauccagacccuc

SEQ ID NO: 25013 - RNA, 20 nt, Artificial Sequence
  targeting sequence with TTCN PAM
ccucucuuggccucaguuuc

SEQ ID NO: 25014 - RNA, 20 nt, Artificial Sequence
  targeting sequence with TTCN PAM
ccuucuguaagcuggggaug

SEQ ID NO: 25015 - RNA, 20 nt, Artificial Sequence
  targeting sequence with TTCN PAM
guaagcuggggaugaugaug

SEQ ID NO: 25016 - RNA, 20 nt, Artificial Sequence
  targeting sequence with TTCN PAM
cuccaaggagcccacaggcc

SEQ ID NO: 25017 - RNA, 20 nt, Artificial Sequence
  targeting sequence with TTCN PAM
agacagugcugcccuggacu

SEQ ID NO: 25018 - RNA, 20 nt, Artificial Sequence
  targeting sequence with TTCN PAM
cuccaucucagucucugugc

SEQ ID NO: 25019 - RNA, 20 nt, Artificial Sequence
  targeting sequence with TTCN PAM
ggcccuauuugaucucaucu

SEQ ID NO: 25020 - RNA, 20 nt, Artificial Sequence
  targeting sequence with TTCN PAM
ggugucuuuucucccucuug

SEQ ID NO: 25021 - RNA, 20 nt, Artificial Sequence
  targeting sequence with TTCN PAM
cccucuugauacuaauaccu

SEQ ID NO: 25022 - RNA, 20 nt, Artificial Sequence
  targeting sequence with TTCN PAM
ugggcacugcaugugagguu

SEQ ID NO: 25023 - RNA, 20 nt, Artificial Sequence
  targeting sequence with TTCN PAM
cauuauaaaacaggucuuau

SEQ ID NO: 25024 - RNA, 20 nt, Artificial Sequence
  targeting sequence with TTCN PAM
uucucauuauaaaacagguc

SEQ ID NO: 25025 - RNA, 20 nt, Artificial Sequence
  targeting sequence with TTCN PAM
cagggcugggagggaugucu

SEQ ID NO: 25026 - RNA, 20 nt, Artificial Sequence
  targeting sequence with TTCN PAM
ccaggccagagggucaucuc

SEQ ID NO: 25027 - RNA, 20 nt, Artificial Sequence
  targeting sequence with TTCN PAM
aggaggauuggcugagauga

SEQ ID NO: 25028 - RNA, 20 nt, Artificial Sequence
  targeting sequence with TTCN PAM
ucacugggagaucacuccca

SEQ ID NO: 25029 - RNA, 20 nt, Artificial Sequence
  targeting sequence with TTCN PAM
aagaugggcuuuacauuugg

SEQ ID NO: 25030 - RNA, 20 nt, Artificial Sequence
  targeting sequence with TTCN PAM
ugacgacgugcacccaccca

SEQ ID NO: 25031 - RNA, 20 nt, Artificial Sequence
  targeting sequence with TTCN PAM
accuuuacuauaaaaagaca

SEQ ID NO: 25032 - RNA, 20 nt, Artificial Sequence
  targeting sequence with TTCN PAM
aggugucuuuuuauaguaaa

SEQ ID NO: 25033 - RNA, 20 nt, Artificial Sequence
  targeting sequence with TTCN PAM
uuuuguuuuaaaaauacaaa

SEQ ID NO: 25034 - RNA, 20 nt, Artificial Sequence
  targeting sequence with TTCN PAM
uagguuggggagaaagacuu

SEQ ID NO: 25035 - RNA, 20 nt, Artificial Sequence
  targeting sequence with TTCN PAM
ccccaaccuaugaaugacca

SEQ ID NO: 25036 - RNA, 20 nt, Artificial Sequence
  targeting sequence with TTCN PAM
ccaagucuuucuccccaacc

SEQ ID NO: 25037 - RNA, 20 nt, Artificial Sequence
  targeting sequence with TTCN PAM
uuccccaagucuuucucccc

SEQ ID NO: 25038 - RNA, 20 nt, Artificial Sequence
  targeting sequence with TTCN PAM
cccaucaguggcacucaaca

SEQ ID NO: 25039 - RNA, 20 nt, Artificial Sequence
  targeting sequence with TTCN PAM
caacuggcuugcacuccaaa

SEQ ID NO: 25040 - RNA, 20 nt, Artificial Sequence
  targeting sequence with TTCN PAM
ucaaaucacaaccuguuugg

SEQ ID NO: 25041 - RNA, 20 nt, Artificial Sequence
  targeting sequence with TTCN PAM
ucacucaguuucucucaaaa

SEQ ID NO: 25042 - RNA, 20 nt, Artificial Sequence
  targeting sequence with TTCN PAM
cucaguuucucucaaaauau

SEQ ID NO: 25043 - RNA, 20 nt, Artificial Sequence
  targeting sequence with TTCN PAM
cucaaaauaucuuaacugcc

SEQ ID NO: 25044 - RNA, 20 nt, Artificial Sequence
  targeting sequence with TTCN PAM
acguauuuggggcaguuaag

SEQ ID NO: 25045 - RNA, 20 nt, Artificial Sequence
  targeting sequence with TTCN PAM
gagggcugcggggaccgagg

SEQ ID NO: 25046 - RNA, 20 nt, Artificial Sequence
  targeting sequence with TTCN PAM
cugccucuggccucacacuu

SEQ ID NO: 25047 - RNA, 20 nt, Artificial Sequence
  targeting sequence with TTCN PAM
gcagcuucucccuuuggguu

SEQ ID NO: 25048 - RNA, 20 nt, Artificial Sequence
  targeting sequence with TTCN PAM
cccuuuggguucucgggaag

SEQ ID NO: 25049 - RNA, 20 nt, Artificial Sequence
  targeting sequence with TTCN PAM
cgggaagaagguggagggca

SEQ ID NO: 25050 - RNA, 20 nt, Artificial Sequence
  targeting sequence with TTCN PAM
cgagaacccaaagggagaag

SEQ ID NO: 25051 - RNA, 20 nt, Artificial Sequence
  targeting sequence with TTCN PAM
ucccgagaacccaaagggag

SEQ ID NO: 25052 - RNA, 20 nt, Artificial Sequence
  targeting sequence with TTCN PAM
cagcugacaggacuugcccu

SEQ ID NO: 25053 - RNA, 20 nt, Artificial Sequence
  targeting sequence with TTCN PAM
ggguucccagcugacaggac

SEQ ID NO: 25054 - RNA, 20 nt, Artificial Sequence
  targeting sequence with TTCN PAM
ugccagggcccaggguucuu

SEQ ID NO: 25055 - RNA, 20 nt, Artificial Sequence
  targeting sequence with TTCN PAM
ucgugagacccucaagcagg

SEQ ID NO: 25056 - RNA, 20 nt, Artificial Sequence
  targeting sequence with TTCN PAM
ugagacccucaagcaggagc

SEQ ID NO: 25057 - RNA, 20 nt, Artificial Sequence
  targeting sequence with TTCN PAM
aaaggccuggcugagcugcc

SEQ ID NO: 25058 - RNA, 20 nt, Artificial Sequence
  targeting sequence with TTCN PAM
gcccugggguccugccccau

SEQ ID NO: 25059 - RNA, 20 nt, Artificial Sequence
  targeting sequence with TTCN PAM
cugucacuggcacugggugg

SEQ ID NO: 25060 - RNA, 20 nt, Artificial Sequence
  targeting sequence with TTCN PAM
ccuggucccaucuggcugga

SEQ ID NO: 25061 - RNA, 20 nt, Artificial Sequence
  targeting sequence with TTCN PAM
aggcuccugguucuccccag

SEQ ID NO: 25062 - RNA, 20 nt, Artificial Sequence
  targeting sequence with TTCN PAM
ccccagaccaaacucauccu

SEQ ID NO: 25063 - RNA, 20 nt, Artificial Sequence
  targeting sequence with TTCN PAM
ccagagguaccccaucacau

SEQ ID NO: 25064 - RNA, 20 nt, Artificial Sequence
  targeting sequence with TTCN PAM
gcuccuccaucccaucacuc

SEQ ID NO: 25065 - RNA, 20 nt, Artificial Sequence
  targeting sequence with TTCN PAM
cuggagacauggcuggccug

SEQ ID NO: 25066 - RNA, 20 nt, Artificial Sequence
  targeting sequence with TTCN PAM
cucagucgcaaauauaucuu

SEQ ID NO: 25067 - RNA, 20 nt, Artificial Sequence
  targeting sequence with TTCN PAM
uucacucagucgcaaauaua

SEQ ID NO: 25068 - RNA, 20 nt, Artificial Sequence
  targeting sequence with TTCN PAM
cgggaggcggccucagccuc

SEQ ID NO: 25069 - RNA, 20 nt, Artificial Sequence
  targeting sequence with TTCN PAM
caccagcuaccuaggggcuu

SEQ ID NO: 25070 - RNA, 20 nt, Artificial Sequence
  targeting sequence with TTCN PAM
aaaauaauagguagaagaau

SEQ ID NO: 25071 - RNA, 20 nt, Artificial Sequence
  targeting sequence with TTCN PAM
accuauuauuuuagaaagcc

SEQ ID NO: 25072 - RNA, 20 nt, Artificial Sequence
  targeting sequence with TTCN PAM
ucuaccuauuauuuuagaaa

SEQ ID NO: 25073 - RNA, 20 nt, Artificial Sequence
  targeting sequence with TTCN PAM
cgagcauuccccuucugcag

SEQ ID NO: 25074 - RNA, 20 nt, Artificial Sequence
  targeting sequence with TTCN PAM
ccuucugcagcggggagacu

SEQ ID NO: 25075 - RNA, 20 nt, Artificial Sequence
  targeting sequence with TTCN PAM
gcagcggggagacucaggug

SEQ ID NO: 25076 - RNA, 20 nt, Artificial Sequence
  targeting sequence with TTCN PAM
cuggcuaaaacccuucaugg

SEQ ID NO: 25077 - RNA, 20 nt, Artificial Sequence
  targeting sequence with TTCN PAM
uggcucccaggaccccagga

SEQ ID NO: 25078 - RNA, 20 nt, Artificial Sequence
  targeting sequence with TTCN PAM
cacucuacucgccuggccac

SEQ ID NO: 25079 - RNA, 20 nt, Artificial Sequence
  targeting sequence with TTCN PAM
cacaggcugcucccuuugcc

SEQ ID NO: 25080 - RNA, 20 nt, Artificial Sequence
  targeting sequence with TTCN PAM
ucuucuccggccucaccugg

SEQ ID NO: 25081 - RNA, 20 nt, Artificial Sequence
  targeting sequence with TTCN PAM
ccggccucaccuggcuuccu

SEQ ID NO: 25082 - RNA, 20 nt, Artificial Sequence
  targeting sequence with TTCN PAM
uccugcuccuccgcccccuc

SEQ ID NO: 25083 - RNA, 20 nt, Artificial Sequence
  targeting sequence with TTCN PAM
cccuuugcggcacgcauugc

SEQ ID NO: 25084 - RNA, 20 nt, Artificial Sequence
  targeting sequence with TTCN PAM
acucuugugggcugggcagg

SEQ ID NO: 25085 - RNA, 20 nt, Artificial Sequence
  targeting sequence with TTCN PAM
agccccagaugacaccucca

SEQ ID NO: 25086 - RNA, 20 nt, Artificial Sequence
  targeting sequence with TTCN PAM
gcagcuguaaacaccccacc

SEQ ID NO: 25087 - RNA, 20 nt, Artificial Sequence
  targeting sequence with TTCN PAM
uguuauuacucuaagggaca

SEQ ID NO: 25088 - RNA, 20 nt, Artificial Sequence
  targeting sequence with TTCN PAM
ucuuguuauuacucuaaggg

SEQ ID NO: 25089 - RNA, 20 nt, Artificial Sequence
  targeting sequence with TTCN PAM
ucuaguccuuaaaacaaugc

SEQ ID NO: 25090 - RNA, 20 nt, Artificial Sequence
  targeting sequence with TTCN PAM
cagaugaagaaacugaggcc

SEQ ID NO: 25091 - RNA, 20 nt, Artificial Sequence
  targeting sequence with TTCN PAM
ucugugaaguggggacagua

SEQ ID NO: 25092 - RNA, 20 nt, Artificial Sequence
  targeting sequence with TTCN PAM
ucaucugugaaguggggaca

SEQ ID NO: 25093 - RNA, 20 nt, Artificial Sequence
  targeting sequence with TTCN PAM
uuggccaaggucacacagcu

SEQ ID NO: 25094 - RNA, 20 nt, Artificial Sequence
  targeting sequence with TTCN PAM
cagcugugugaccuuggcca

SEQ ID NO: 25095 - RNA, 20 nt, Artificial Sequence
  targeting sequence with TTCN PAM
agucccacuuugucacuucc

SEQ ID NO: 25096 - RNA, 20 nt, Artificial Sequence
  targeting sequence with TTCN PAM
gaaucugucgcugcauagcu

SEQ ID NO: 25097 - RNA, 20 nt, Artificial Sequence
  targeting sequence with TTCN PAM
gaaccuagacuuugcaucag

SEQ ID NO: 25098 - RNA, 20 nt, Artificial Sequence
  targeting sequence with TTCN PAM
ugcuccaggcuguugccagc

SEQ ID NO: 25099 - RNA, 20 nt, Artificial Sequence
  targeting sequence with TTCN PAM
ccgugcccgcugugggcaca

SEQ ID NO: 25100 - RNA, 20 nt, Artificial Sequence
  targeting sequence with TTCN PAM
ccucuucgccgugcccgcug

SEQ ID NO: 25101 - RNA, 20 nt, Artificial Sequence
  targeting sequence with TTCN PAM
acacccuucuccucuucgcc

SEQ ID NO: 25102 - RNA, 20 nt, Artificial Sequence
  targeting sequence with TTCN PAM
uuggucacccucccuguguu

SEQ ID NO: 25103 - RNA, 20 nt, Artificial Sequence
  targeting sequence with TTCN PAM
ggcugcggccuuccuugguc

SEQ ID NO: 25104 - RNA, 20 nt, Artificial Sequence
  targeting sequence with TTCN PAM
ccaccccaaggccacagauu

SEQ ID NO: 25105 - RNA, 20 nt, Artificial Sequence
  targeting sequence with TTCN PAM
ccacucuguccuggggcugu

SEQ ID NO: 25106 - RNA, 20 nt, Artificial Sequence
  targeting sequence with TTCN PAM
cuaccuaaggggacagggcc

SEQ ID NO: 25107 - RNA, 20 nt, Artificial Sequence
  targeting sequence with TTCN PAM
cacgguccgcucccucggug

SEQ ID NO: 25108 - RNA, 20 nt, Artificial Sequence
  targeting sequence with TTCN PAM
gguucccacgguccgcuccc

SEQ ID NO: 25109 - RNA, 20 nt, Artificial Sequence
  targeting sequence with TTCN PAM
ugccagagggggagggaacc

SEQ ID NO: 25110 - RNA, 20 nt, Artificial Sequence
  targeting sequence with TTCN PAM
cucccccucuggcaagaacc

SEQ ID NO: 25111 - RNA, 20 nt, Artificial Sequence
  targeting sequence with TTCN PAM
uuaggccagcccaggguucc

SEQ ID NO: 25112 - RNA, 20 nt, Artificial Sequence
  targeting sequence with TTCN PAM
ggcccugugucucggcccuu

SEQ ID NO: 25113 - RNA, 20 nt, Artificial Sequence
  targeting sequence with TTCN PAM
uccaguaguuucaggcccug

SEQ ID NO: 25114 - RNA, 20 nt, Artificial Sequence
  targeting sequence with TTCN PAM
cuccauucagcgacucccca

SEQ ID NO: 25115 - RNA, 20 nt, Artificial Sequence
  targeting sequence with TTCN PAM
gcgacuccccacugagaccc

SEQ ID NO: 25116 - RNA, 20 nt, Artificial Sequence
  targeting sequence with TTCN PAM
ucucgcaggcaacuguguuu

SEQ ID NO: 25117 - RNA, 20 nt, Artificial Sequence
  targeting sequence with TTCN PAM
uccaccaucuccaccccaga

SEQ ID NO: 25118 - RNA, 20 nt, Artificial Sequence
  targeting sequence with TTCN PAM
ggguggccggccagauggug

SEQ ID NO: 25119 - RNA, 20 nt, Artificial Sequence
  targeting sequence with TTCN PAM
cccaaggucgaggucggucu

SEQ ID NO: 25120 - RNA, 20 nt, Artificial Sequence
  targeting sequence with TTCN PAM
uucucccaaggucgaggucg

SEQ ID NO: 25121 - RNA, 20 nt, Artificial Sequence
  targeting sequence with TTCN PAM
caaagccccaguguugggcc

SEQ ID NO: 25122 - RNA, 20 nt, Artificial Sequence
  targeting sequence with TTCN PAM
ucugugggcgggcccaacac

SEQ ID NO: 25123 - RNA, 20 nt, Artificial Sequence
  targeting sequence with TTCN PAM
ugagauuaaccauuccucug

SEQ ID NO: 25124 - RNA, 20 nt, Artificial Sequence
  targeting sequence with TTCN PAM
ugucacagccauggagaagg

SEQ ID NO: 25125 - RNA, 20 nt, Artificial Sequence
  targeting sequence with TTCN PAM
ccauggcugugacaagaauu

SEQ ID NO: 25126 - RNA, 20 nt, Artificial Sequence
  targeting sequence with TTCN PAM
uuggggccccacccuguccc

SEQ ID NO: 25127 - RNA, 20 nt, Artificial Sequence
  targeting sequence with TTCN PAM
uguggugacccaagccuucc

SEQ ID NO: 25128 - RNA, 20 nt, Artificial Sequence
  targeting sequence with TTCN PAM
gcauuuugcugauggagaug

SEQ ID NO: 25129 - RNA, 20 nt, Artificial Sequence
  targeting sequence with TTCN PAM
uaagggaauggcaggcagug

SEQ ID NO: 25130 - RNA, 20 nt, Artificial Sequence
  targeting sequence with TTCN PAM
cuuaggaagcugcaucucca

SEQ ID NO: 25131 - RNA, 20 nt, Artificial Sequence
  targeting sequence with TTCN PAM
gcuccacugccugccauucc

SEQ ID NO: 25132 - RNA, 20 nt, Artificial Sequence
  targeting sequence with TTCN PAM
cacacccuccacccaucuga

SEQ ID NO: 25133 - RNA, 20 nt, Artificial Sequence
  targeting sequence with TTCN PAM
ggggccucauuccucagggu

SEQ ID NO: 25134 - RNA, 20 nt, Artificial Sequence
  targeting sequence with TTCN PAM
ucagggugaacuauggggau

SEQ ID NO: 25135 - RNA, 20 nt, Artificial Sequence
  targeting sequence with TTCN PAM
cccugaggaaugaggcccca

SEQ ID NO: 25136 - RNA, 20 nt, Artificial Sequence
  targeting sequence with TTCN PAM
uggcaagggauugcuccuca

SEQ ID NO: 25137 - RNA, 20 nt, Artificial Sequence
  targeting sequence with TTCN PAM
uuucagggaaccacaccaag

SEQ ID NO: 25138 - RNA, 20 nt, Artificial Sequence
  targeting sequence with TTCN PAM
gggaaccacaccaagucccc

SEQ ID NO: 25139 - RNA, 20 nt, Artificial Sequence
  targeting sequence with TTCN PAM
cugaaaggaaguucauggca

SEQ ID NO: 25140 - RNA, 20 nt, Artificial Sequence
  targeting sequence with TTCN PAM
gucaaccuggccccccuugc

SEQ ID NO: 25141 - RNA, 20 nt, Artificial Sequence
  targeting sequence with TTCN PAM
ccacugagccccacggcccu

SEQ ID NO: 25142 - RNA, 20 nt, Artificial Sequence
  targeting sequence with TTCN PAM
caucccuccauucuccuggc

SEQ ID NO: 25143 - RNA, 20 nt, Artificial Sequence
  targeting sequence with TTCN PAM
ccuggcccuggcaucugccc

SEQ ID NO: 25144 - RNA, 20 nt, Artificial Sequence
  targeting sequence with TTCN PAM
ggacuuggaucucagagugc

SEQ ID NO: 25145 - RNA, 20 nt, Artificial Sequence
  targeting sequence with TTCN PAM
aauccaccucugcuagugcc

SEQ ID NO: 25146 - RNA, 20 nt, Artificial Sequence
  targeting sequence with TTCN PAM
ucaucuguaaaaugugauga

SEQ ID NO: 25147 - RNA, 20 nt, Artificial Sequence
  targeting sequence with TTCN PAM
ucuguaaaaugugaugagaa

SEQ ID NO: 25148 - RNA, 20 nt, Artificial Sequence
  targeting sequence with TTCN PAM
caucacauuuuacagaugaa

SEQ ID NO: 25149 - RNA, 20 nt, Artificial Sequence
  targeting sequence with TTCN PAM
gagaacugggaauugugaca

SEQ ID NO: 25150 - RNA, 20 nt, Artificial Sequence
  targeting sequence with TTCN PAM
cagaacaacccucucaggua

SEQ ID NO: 25151 - RNA, 20 nt, Artificial Sequence
  targeting sequence with TTCN PAM
caguucucagaacaacccuc

SEQ ID NO: 25152 - RNA, 20 nt, Artificial Sequence
  targeting sequence with TTCN PAM
ugagcaccuaguauguacca

SEQ ID NO: 25153 - RNA, 20 nt, Artificial Sequence
  targeting sequence with TTCN PAM
gcaaauauuuccugagcacc

SEQ ID NO: 25154 - RNA, 20 nt, Artificial Sequence
  targeting sequence with TTCN PAM
ccuauucugcaaauauuucc

SEQ ID NO: 25155 - RNA, 20 nt, Artificial Sequence
  targeting sequence with TTCN PAM
ggccccagcuugcuggcaca

SEQ ID NO: 25156 - RNA, 20 nt, Artificial Sequence
  targeting sequence with TTCN PAM
ggggccacugcgugagccug

SEQ ID NO: 25157 - RNA, 20 nt, Artificial Sequence
  targeting sequence with TTCN PAM
cgcgugcacaccuggguucc

SEQ ID NO: 25158 - RNA, 20 nt, Artificial Sequence
  targeting sequence with TTCN PAM
acguacaucuggaucucugc

SEQ ID NO: 25159 - RNA, 20 nt, Artificial Sequence
  targeting sequence with TTCN PAM
cgcccgcccccgcccccgcc

SEQ ID NO: 25160 - RNA, 20 nt, Artificial Sequence
  targeting sequence with TTCN PAM
acgaagcaggcggugcgcgc

SEQ ID NO: 25161 - RNA, 20 nt, Artificial Sequence
  targeting sequence with TTCN PAM
uggaaccggcgcccgacgug

SEQ ID NO: 25162 - RNA, 20 nt, Artificial Sequence
  targeting sequence with TTCN PAM
ccgacgugcgagccgccauc

SEQ ID NO: 25163 - RNA, 20 nt, Artificial Sequence
  targeting sequence with TTCN PAM
gcuucgccgacgugcgagcc

SEQ ID NO: 25164 - RNA, 20 nt, Artificial Sequence
  targeting sequence with TTCN PAM
agcggccccagggguccccc

SEQ ID NO: 25165 - RNA, 20 nt, Artificial Sequence
  targeting sequence with TTCN PAM
cagcccgggagcggcucuuu

SEQ ID NO: 25166 - RNA, 20 nt, Artificial Sequence
  targeting sequence with TTCN PAM
uggcgucgccgccggcgccg

SEQ ID NO: 25167 - RNA, 20 nt, Artificial Sequence
  targeting sequence with TTCN PAM
ugcacccguccgacccgccg

SEQ ID NO: 25168 - RNA, 20 nt, Artificial Sequence
  targeting sequence with TTCN PAM
ugagcgccuuccugcacccg

SEQ ID NO: 25169 - RNA, 20 nt, Artificial Sequence
  targeting sequence with TTCN PAM
accucaaccccuccgacgac

SEQ ID NO: 25170 - RNA, 20 nt, Artificial Sequence
  targeting sequence with TTCN PAM
ccuucgaccucaaccccucc

SEQ ID NO: 25171 - RNA, 20 nt, Artificial Sequence
  targeting sequence with TTCN PAM
cgaagcggugguccuccagg

SEQ ID NO: 25172 - RNA, 20 nt, Artificial Sequence
  targeting sequence with TTCN PAM
agaacacgcccgagaucgcc

SEQ ID NO: 25173 - RNA, 20 nt, Artificial Sequence
  targeting sequence with TTCN PAM
cgcgcaaccgcagccuggag

SEQ ID NO: 25174 - RNA, 20 nt, Artificial Sequence
  targeting sequence with TTCN PAM
ucccgcgcaaccgcagccug

SEQ ID NO: 25175 - RNA, 20 nt, Artificial Sequence
  targeting sequence with TTCN PAM
gccucccgccgcgggcgcgg

SEQ ID NO: 25176 - RNA, 20 nt, Artificial Sequence
  targeting sequence with TTCN PAM
ggugguuggccgccacguuc

SEQ ID NO: 25177 - RNA, 20 nt, Artificial Sequence
  targeting sequence with TTCN PAM
gcaugcuggggaacaccgug

SEQ ID NO: 25178 - RNA, 20 nt, Artificial Sequence
  targeting sequence with TTCN PAM
ccagcaugcugaacguggcg

SEQ ID NO: 25179 - RNA, 20 nt, Artificial Sequence
  targeting sequence with TTCN PAM
cgcccgccgcgccgcccgcc

SEQ ID NO: 25180 - RNA, 20 nt, Artificial Sequence
  targeting sequence with TTCN PAM
gccagcugcggcgccggggc

SEQ ID NO: 25181 - RNA, 20 nt, Artificial Sequence
  targeting sequence with TTCN PAM
cccuggacggcgcggcgggg

SEQ ID NO: 25182 - RNA, 20 nt, Artificial Sequence
  targeting sequence with TTCN PAM
ccucgcccacgcccaccaac

SEQ ID NO: 25183 - RNA, 20 nt, Artificial Sequence
  targeting sequence with TTCN PAM
agacgccgccgcggugcccg

SEQ ID NO: 25184 - RNA, 20 nt, Artificial Sequence
  targeting sequence with TTCN PAM
ugcccgcgccagccgccccc

SEQ ID NO: 25185 - RNA, 20 nt, Artificial Sequence
  targeting sequence with TTCN PAM
ucccacuuggccgcuuggcc

SEQ ID NO: 25186 - RNA, 20 nt, Artificial Sequence
  targeting sequence with TTCN PAM
cuuuuccgcccucuccccca

SEQ ID NO: 25187 - RNA, 20 nt, Artificial Sequence
  targeting sequence with TTCN PAM
gcccucucccccaccccguc

SEQ ID NO: 25188 - RNA, 20 nt, Artificial Sequence
  targeting sequence with TTCN PAM
ccggguucugccucugcuuc

SEQ ID NO: 25189 - RNA, 20 nt, Artificial Sequence
  targeting sequence with TTCN PAM
gccucugcuucuccuucucc

SEQ ID NO: 25190 - RNA, 20 nt, Artificial Sequence
  targeting sequence with TTCN PAM
ccuucucccuccgacuccgc

SEQ ID NO: 25191 - RNA, 20 nt, Artificial Sequence
  targeting sequence with TTCN PAM
cccuccgacuccgcuucgcu

SEQ ID NO: 25192 - RNA, 20 nt, Artificial Sequence
  targeting sequence with TTCN PAM
cucuccagucccuggcagcc

SEQ ID NO: 25193 - RNA, 20 nt, Artificial Sequence
  targeting sequence with TTCN PAM
agucuccuucucucuccugc

SEQ ID NO: 25194 - RNA, 20 nt, Artificial Sequence
  targeting sequence with TTCN PAM
cucuccugcuccguuuuucc

SEQ ID NO: 25195 - RNA, 20 nt, Artificial Sequence
  targeting sequence with TTCN PAM
gucccugacgcucgcucccu

SEQ ID NO: 25196 - RNA, 20 nt, Artificial Sequence
  targeting sequence with TTCN PAM
uucucccucugccuucccga

SEQ ID NO: 25197 - RNA, 20 nt, Artificial Sequence
  targeting sequence with TTCN PAM
cccucugccuucccgaaccc

SEQ ID NO: 25198 - RNA, 20 nt, Artificial Sequence
  targeting sequence with TTCN PAM
cgaacccugugucuccccuc

SEQ ID NO: 25199 - RNA, 20 nt, Artificial Sequence
  targeting sequence with TTCN PAM
ggaaggcagagggagaagga

SEQ ID NO: 25200 - RNA, 20 nt, Artificial Sequence
  targeting sequence with TTCN PAM
caggcacuguccaggccuuc

SEQ ID NO: 25201 - RNA, 20 nt, Artificial Sequence
  targeting sequence with TTCN PAM
cucccccggugccggccagu

SEQ ID NO: 25202 - RNA, 20 nt, Artificial Sequence
  targeting sequence with TTCN PAM
ucauuuauauaucugacccu

SEQ ID NO: 25203 - RNA, 20 nt, Artificial Sequence
  targeting sequence with TTCN PAM
ucucuccauguuuuccucau

SEQ ID NO: 25204 - RNA, 20 nt, Artificial Sequence
  targeting sequence with TTCN PAM
agccaguggcccacaaccga

SEQ ID NO: 25205 - RNA, 20 nt, Artificial Sequence
  targeting sequence with TTCN PAM
cugacauccucccaggcuua

SEQ ID NO: 25206 - RNA, 20 nt, Artificial Sequence
  targeting sequence with TTCN PAM
acuaagccugggaggauguc

SEQ ID NO: 25207 - RNA, 20 nt, Artificial Sequence
  targeting sequence with TTCN PAM
ugaucucaaaagcagcguua

SEQ ID NO: 25208 - RNA, 20 nt, Artificial Sequence
  targeting sequence with TTCN PAM
aaggucacagcccugugagg

SEQ ID NO: 25209 - RNA, 20 nt, Artificial Sequence
  targeting sequence with TTCN PAM
ucacagauucccccgaggcg

SEQ ID NO: 25210 - RNA, 20 nt, Artificial Sequence
  targeting sequence with TTCN PAM
cccgaggcgagcgcuauugg

SEQ ID NO: 25211 - RNA, 20 nt, Artificial Sequence
  targeting sequence with TTCN PAM
agauauggaaaccaaggcug

SEQ ID NO: 25212 - RNA, 20 nt, Artificial Sequence
  targeting sequence with TTCN PAM
auaucuggaagauggguuac

SEQ ID NO: 25213 - RNA, 20 nt, Artificial Sequence
  targeting sequence with TTCN PAM
ccucagccuugguuuccaua

SEQ ID NO: 25214 - RNA, 20 nt, Artificial Sequence
  targeting sequence with TTCN PAM
aacacuguagcucugcuccu

SEQ ID NO: 25215 - RNA, 20 nt, Artificial Sequence
  targeting sequence with TTCN PAM
gcuccgaccucucagaacgg

SEQ ID NO: 25216 - RNA, 20 nt, Artificial Sequence
  targeting sequence with TTCN PAM
gagaggucggagcugaaggg

SEQ ID NO: 25217 - RNA, 20 nt, Artificial Sequence
  targeting sequence with TTCN PAM
acagggugcccggugggccu

SEQ ID NO: 25218 - RNA, 20 nt, Artificial Sequence
  targeting sequence with TTCN PAM
ucuuucccacccaaccagga

SEQ ID NO: 25219 - RNA, 20 nt, Artificial Sequence
  targeting sequence with TTCN PAM
cacccaaccaggaaggaagg

SEQ ID NO: 25220 - RNA, 20 nt, Artificial Sequence
  targeting sequence with TTCN PAM
ugguugggugggaaagagga

SEQ ID NO: 25221 - RNA, 20 nt, Artificial Sequence
  targeting sequence with TTCN PAM
uuccugguugggugggaaag

SEQ ID NO: 25222 - RNA, 20 nt, Artificial Sequence
  targeting sequence with TTCN PAM
ugccggccccauggugcaca

SEQ ID NO: 25223 - RNA, 20 nt, Artificial Sequence
  targeting sequence with TTCN PAM
cucaacacccucgccuuccu

SEQ ID NO: 25224 - RNA, 20 nt, Artificial Sequence
  targeting sequence with TTCN PAM
ugccauccugcccgccuugu

SEQ ID NO: 25225 - RNA, 20 nt, Artificial Sequence
  targeting sequence with TTCN PAM
agaccccucagcccuggucu

SEQ ID NO: 25226 - RNA, 20 nt, Artificial Sequence
  targeting sequence with TTCN PAM
ugcagcucaacacucccggc

SEQ ID NO: 25227 - RNA, 20 nt, Artificial Sequence
  targeting sequence with TTCN PAM
ucucuggauggagaaggcgc

SEQ ID NO: 25228 - RNA, 20 nt, Artificial Sequence
  targeting sequence with TTCN PAM
ccauccagagaggaagacag

SEQ ID NO: 25229 - RNA, 20 nt, Artificial Sequence
  targeting sequence with TTCN PAM
uaucugucuugcuccucccg

SEQ ID NO: 25230 - RNA, 20 nt, Artificial Sequence
  targeting sequence with TTCN PAM
cucucuuugucucuccuucu

SEQ ID NO: 25231 - RNA, 20 nt, Artificial Sequence
  targeting sequence with TTCN PAM
cucagugucuugcccccuuc

SEQ ID NO: 25232 - RNA, 20 nt, Artificial Sequence
  targeting sequence with TTCN PAM
cuuuccacucuucaucuguc

SEQ ID NO: 25233 - RNA, 20 nt, Artificial Sequence
  targeting sequence with TTCN PAM
acucuucaucugucucucug

SEQ ID NO: 25234 - RNA, 20 nt, Artificial Sequence
  targeting sequence with TTCN PAM
ucugucucucugugucucua

SEQ ID NO: 25235 - RNA, 20 nt, Artificial Sequence
  targeting sequence with TTCN PAM
uuccugucucccgcucaucu

SEQ ID NO: 25236 - RNA, 20 nt, Artificial Sequence
  targeting sequence with TTCN PAM
ugucucccgcucaucugguu

SEQ ID NO: 25237 - RNA, 20 nt, Artificial Sequence
  targeting sequence with TTCN PAM
ucuugcugcauccugcagcu

SEQ ID NO: 25238 - RNA, 20 nt, Artificial Sequence
  targeting sequence with TTCN PAM
ccuagagagcuccuaaaccc

SEQ ID NO: 25239 - RNA, 20 nt, Artificial Sequence
  targeting sequence with TTCN PAM
ggucugaguauccucacauc

SEQ ID NO: 25240 - RNA, 20 nt, Artificial Sequence
  targeting sequence with TTCN PAM
caccuccaguugaugugagg

SEQ ID NO: 25241 - RNA, 20 nt, Artificial Sequence
  targeting sequence with TTCN PAM
ucaacuguaaaaugaggaca

SEQ ID NO: 25242 - RNA, 20 nt, Artificial Sequence
  targeting sequence with TTCN PAM
gcuacgauuguccucauuuu

SEQ ID NO: 25243 - RNA, 20 nt, Artificial Sequence
  targeting sequence with TTCN PAM
ccaucucacacccucccagg

SEQ ID NO: 25244 - RNA, 20 nt, Artificial Sequence
  targeting sequence with TTCN PAM
ccccgccuuguggcagugaa

SEQ ID NO: 25245 - RNA, 20 nt, Artificial Sequence
  targeting sequence with TTCN PAM
cugccacaaggcggggagaa

SEQ ID NO: 25246 - RNA, 20 nt, Artificial Sequence
  targeting sequence with TTCN PAM
ggggucaugguucacugcca

SEQ ID NO: 25247 - RNA, 20 nt, Artificial Sequence
  targeting sequence with TTCN PAM
cucucaccgucugguggcuc

SEQ ID NO: 25248 - RNA, 20 nt, Artificial Sequence
  targeting sequence with TTCN PAM
cagauggggaaacugagggg

SEQ ID NO: 25249 - RNA, 20 nt, Artificial Sequence
  targeting sequence with TTCN PAM
ccaucugugaaauggguuug

SEQ ID NO: 25250 - RNA, 20 nt, Artificial Sequence
  targeting sequence with TTCN PAM
auccuuaccuugcuaaugcc

SEQ ID NO: 25251 - RNA, 20 nt, Artificial Sequence
  targeting sequence with TTCN PAM
cccuucuacccauuagcugg

SEQ ID NO: 25252 - RNA, 20 nt, Artificial Sequence
  targeting sequence with TTCN PAM
acccauuagcugggagcacc

SEQ ID NO: 25253 - RNA, 20 nt, Artificial Sequence
  targeting sequence with TTCN PAM
gccaguaauugucagcaccu

SEQ ID NO: 25254 - RNA, 20 nt, Artificial Sequence
  targeting sequence with TTCN PAM
uucagccaguaauugucagc

SEQ ID NO: 25255 - RNA, 20 nt, Artificial Sequence
  targeting sequence with TTCN PAM
uucauucagccaguaauugu

SEQ ID NO: 25256 - RNA, 20 nt, Artificial Sequence
  targeting sequence with TTCN PAM
uuuauucauucauucagcca

SEQ ID NO: 25257 - RNA, 20 nt, Artificial Sequence
  targeting sequence with TTCN PAM
uuccuuuauucauucauuca

SEQ ID NO: 25258 - RNA, 20 nt, Artificial Sequence
  targeting sequence with TTCN PAM
cuggccuuacuaagaugcaa

SEQ ID NO: 25259 - RNA, 20 nt, Artificial Sequence
  targeting sequence with TTCN PAM
uccagagggaauuuuggagg

SEQ ID NO: 25260 - RNA, 20 nt, Artificial Sequence
  targeting sequence with TTCN PAM
agagggaauuuuggagggaa

SEQ ID NO: 25261 - RNA, 20 nt, Artificial Sequence
  targeting sequence with TTCN PAM
cucuggaagaacaccucauu

SEQ ID NO: 25262 - RNA, 20 nt, Artificial Sequence
  targeting sequence with TTCN PAM
cuccaaaauucccucuggaa

SEQ ID NO: 25263 - RNA, 20 nt, Artificial Sequence
  targeting sequence with TTCN PAM
ucuccccuugguucccucca

SEQ ID NO: 25264 - RNA, 20 nt, Artificial Sequence
  targeting sequence with TTCN PAM
aaguuaguuauugcuggguc

SEQ ID NO: 25265 - RNA, 20 nt, Artificial Sequence
  targeting sequence with TTCN PAM
uuccaaguuaguuauugcug

SEQ ID NO: 25266 - RNA, 20 nt, Artificial Sequence
  targeting sequence with TTCN PAM
ggguuaguucauuccaaguu

SEQ ID NO: 25267 - RNA, 20 nt, Artificial Sequence
  targeting sequence with TTCN PAM
cacugcaauuugggccuuuu

SEQ ID NO: 25268 - RNA, 20 nt, Artificial Sequence
  targeting sequence with TTCN PAM
guuuuuguucaagucugauu

SEQ ID NO: 25269 - RNA, 20 nt, Artificial Sequence
  targeting sequence with TTCN PAM
agucugauuauaucaaggaa

SEQ ID NO: 25270 - RNA, 20 nt, Artificial Sequence
  targeting sequence with TTCN PAM
uugauauaaucagacuugaa

SEQ ID NO: 25271 - RNA, 20 nt, Artificial Sequence
  targeting sequence with TTCN PAM
cucuauuaaaaagagacagu

SEQ ID NO: 25272 - RNA, 20 nt, Artificial Sequence
  targeting sequence with TTCN PAM
agcacgcugaugucaacagc

SEQ ID NO: 25273 - RNA, 20 nt, Artificial Sequence
  targeting sequence with TTCN PAM
uuguacuugccguuacuuuc

SEQ ID NO: 25274 - RNA, 20 nt, Artificial Sequence
  targeting sequence with TTCN PAM
gguuuuggcaagugcuacug

SEQ ID NO: 25275 - RNA, 20 nt, Artificial Sequence
  targeting sequence with TTCN PAM
auguacaguaaugauguaaa

SEQ ID NO: 25276 - RNA, 20 nt, Artificial Sequence
  targeting sequence with TTCN PAM
uugauaaaugcauugauuga

SEQ ID NO: 25277 - RNA, 20 nt, Artificial Sequence
  targeting sequence with TTCN PAM
aucaaugcauuuaucaagga

SEQ ID NO: 25278 - RNA, 20 nt, Artificial Sequence
  targeting sequence with TTCN PAM
cauuugucuuuaacucacuu

SEQ ID NO: 25279 - RNA, 20 nt, Artificial Sequence
  targeting sequence with TTCN PAM
ggcauuuugguggcaucugg

SEQ ID NO: 25280 - RNA, 20 nt, Artificial Sequence
  targeting sequence with TTCN PAM
caaauuucaggcauuuuggu

SEQ ID NO: 25281 - RNA, 20 nt, Artificial Sequence
  targeting sequence with TTCN PAM
aaggcacugcuggacauuuc

SEQ ID NO: 25282 - RNA, 20 nt, Artificial Sequence
  targeting sequence with TTCN PAM
ccgagccagcauagccguug

SEQ ID NO: 25283 - RNA, 20 nt, Artificial Sequence
  targeting sequence with TTCN PAM
accccacugggugggcuucc

SEQ ID NO: 25284 - RNA, 20 nt, Artificial Sequence
  targeting sequence with TTCN PAM
cacccuguccuguccauucu

SEQ ID NO: 25285 - RNA, 20 nt, Artificial Sequence
  targeting sequence with TTCN PAM
caccucugacugcccagggc

SEQ ID NO: 25286 - RNA, 20 nt, Artificial Sequence
  targeting sequence with TTCN PAM
ucugucuccucacagcucug

SEQ ID NO: 25287 - RNA, 20 nt, Artificial Sequence
  targeting sequence with TTCN PAM
ucuucaauuggaaaaaauaa

SEQ ID NO: 25288 - RNA, 20 nt, Artificial Sequence
  targeting sequence with TTCN PAM
ucaauuggaaaaaauaacag

SEQ ID NO: 25289 - RNA, 20 nt, Artificial Sequence
  targeting sequence with TTCN PAM
auuggaaaaaauaacagugg

SEQ ID NO: 25290 - RNA, 20 nt, Artificial Sequence
  targeting sequence with TTCN PAM
aauugaagaagaaaaacauu

SEQ ID NO: 25291 - RNA, 20 nt, Artificial Sequence
  targeting sequence with TTCN PAM
cagaggccaggcccaaggga

SEQ ID NO: 25292 - RNA, 20 nt, Artificial Sequence
  targeting sequence with TTCN PAM
uugcaggaaaugccccugca

SEQ ID NO: 25293 - RNA, 20 nt, Artificial Sequence
  targeting sequence with TTCN PAM
ugcaaggaaacguucucaga

SEQ ID NO: 25294 - RNA, 20 nt, Artificial Sequence
  targeting sequence with TTCN PAM
uguggcugaggcggugcucu

SEQ ID NO: 25295 - RNA, 20 nt, Artificial Sequence
  targeting sequence with TTCN PAM
agcaccuuccuguggcugag

SEQ ID NO: 25296 - RNA, 20 nt, Artificial Sequence
  targeting sequence with TTCN PAM
cgggggcuggacccgucuca

SEQ ID NO: 25297 - RNA, 20 nt, Artificial Sequence
  targeting sequence with TTCN PAM
ccgugggagcaacccugcgg

SEQ ID NO: 25298 - RNA, 20 nt, Artificial Sequence
  targeting sequence with TTCN PAM
cacucauaggugggaacuga

SEQ ID NO: 25299 - RNA, 20 nt, Artificial Sequence
  targeting sequence with TTCN PAM
guccuugcgauaguuugcuc

SEQ ID NO: 25300 - RNA, 20 nt, Artificial Sequence
  targeting sequence with TTCN PAM
gagcaaacuaucgcaaggac

SEQ ID NO: 25301 - RNA, 20 nt, Artificial Sequence
  targeting sequence with TTCN PAM
agcuucauccaugucccuac

SEQ ID NO: 25302 - RNA, 20 nt, Artificial Sequence
  targeting sequence with TTCN PAM
uccaugucccuacaaaggac

SEQ ID NO: 25303 - RNA, 20 nt, Artificial Sequence
  targeting sequence with TTCN PAM
uguccuuuguagggacaugg

SEQ ID NO: 25304 - RNA, 20 nt, Artificial Sequence
  targeting sequence with TTCN PAM
augguguauaugugccacau

SEQ ID NO: 25305 - RNA, 20 nt, Artificial Sequence
  targeting sequence with TTCN PAM
uaauccagucuaucauugau

SEQ ID NO: 25306 - RNA, 20 nt, Artificial Sequence
  targeting sequence with TTCN PAM
ccucuccuccugagcacaga

SEQ ID NO: 25307 - RNA, 20 nt, Artificial Sequence
  targeting sequence with TTCN PAM
ucucaucucuguguccccgu

SEQ ID NO: 25308 - RNA, 20 nt, Artificial Sequence
  targeting sequence with TTCN PAM
uccagccccacggggacaca

SEQ ID NO: 25309 - RNA, 20 nt, Artificial Sequence
  targeting sequence with TTCN PAM
cauuccugcaugugaacgac

SEQ ID NO: 25310 - RNA, 20 nt, Artificial Sequence
  targeting sequence with TTCN PAM
ugcaugugaacgacgcccuc

SEQ ID NO: 25311 - RNA, 20 nt, Artificial Sequence
  targeting sequence with TTCN PAM
caugcaggaaugagaaccau

SEQ ID NO: 25312 - RNA, 20 nt, Artificial Sequence
  targeting sequence with TTCN PAM
cagacguccagucauggguc

SEQ ID NO: 25313 - RNA, 20 nt, Artificial Sequence
  targeting sequence with TTCN PAM
cgggcccagacccaugacug

SEQ ID NO: 25314 - RNA, 20 nt, Artificial Sequence
  targeting sequence with TTCN PAM
gcuggacagaggccucagug

SEQ ID NO: 25315 - RNA, 20 nt, Artificial Sequence
  targeting sequence with TTCN PAM
cuggcugccaucuccaggcg

SEQ ID NO: 25316 - RNA, 20 nt, Artificial Sequence
  targeting sequence with TTCN PAM
aauccaggaccagggccuca

SEQ ID NO: 25317 - RNA, 20 nt, Artificial Sequence
  targeting sequence with TTCN PAM
cgguaggguuauugugaggu

SEQ ID NO: 25318 - RNA, 20 nt, Artificial Sequence
  targeting sequence with TTCN PAM
cuaccuguaaauagguaugu

SEQ ID NO: 25319 - RNA, 20 nt, Artificial Sequence
  targeting sequence with TTCN PAM
ccugccucagccucccgagu

SEQ ID NO: 25320 - RNA, 20 nt, Artificial Sequence
  targeting sequence with TTCN PAM
uaaugaacuugagucuccau

SEQ ID NO: 25321 - RNA, 20 nt, Artificial Sequence
  targeting sequence with TTCN PAM
uuaagaacaggacucaggcc

SEQ ID NO: 25322 - RNA, 20 nt, Artificial Sequence
  targeting sequence with TTCN PAM
ccuucucuggaaagucuuuc

SEQ ID NO: 25323 - RNA, 20 nt, Artificial Sequence
  targeting sequence with TTCN PAM
cuggaaagucuuuccuagug

SEQ ID NO: 25324 - RNA, 20 nt, Artificial Sequence
  targeting sequence with TTCN PAM
agagaaggugaaauuggguu

SEQ ID NO: 25325 - RNA, 20 nt, Artificial Sequence
  targeting sequence with TTCN PAM
uagugaacuccuaggccucc

SEQ ID NO: 25326 - RNA, 20 nt, Artificial Sequence
  targeting sequence with TTCN PAM
cuaggaaagacuuuccagag

SEQ ID NO: 25327 - RNA, 20 nt, Artificial Sequence
  targeting sequence with TTCN PAM
gagaagacuuccuugagccu

SEQ ID NO: 25328 - RNA, 20 nt, Artificial Sequence
  targeting sequence with TTCN PAM
cagaaggucuuuagacuagg

SEQ ID NO: 25329 - RNA, 20 nt, Artificial Sequence
  targeting sequence with TTCN PAM
uugagccucaaagcaguauu

SEQ ID NO: 25330 - RNA, 20 nt, Artificial Sequence
  targeting sequence with TTCN PAM
cuggccagaguccucucugc

SEQ ID NO: 25331 - RNA, 20 nt, Artificial Sequence
  targeting sequence with TTCN PAM
uccgcagagaggacucuggc

SEQ ID NO: 25332 - RNA, 20 nt, Artificial Sequence
  targeting sequence with TTCN PAM
uuagggaguuuugggugaca

SEQ ID NO: 25333 - RNA, 20 nt, Artificial Sequence
  targeting sequence with TTCN PAM
cguaaggcugcucuugagua

SEQ ID NO: 25334 - RNA, 20 nt, Artificial Sequence
  targeting sequence with TTCN PAM
ccuguggcuuccccugugac

SEQ ID NO: 25335 - RNA, 20 nt, Artificial Sequence
  targeting sequence with TTCN PAM
ccugugacuuccccacuccu

SEQ ID NO: 25336 - RNA, 20 nt, Artificial Sequence
  targeting sequence with TTCN PAM
aggcagccuucucagcucuc

SEQ ID NO: 25337 - RNA, 20 nt, Artificial Sequence
  targeting sequence with TTCN PAM
cagcucucacaggcuggguu

SEQ ID NO: 25338 - RNA, 20 nt, Artificial Sequence
  targeting sequence with TTCN PAM
uccuccucuacccccacagu

SEQ ID NO: 25339 - RNA, 20 nt, Artificial Sequence
  targeting sequence with TTCN PAM
ugaggccacugugaggaccc

SEQ ID NO: 25340 - RNA, 20 nt, Artificial Sequence
  targeting sequence with TTCN PAM
gccuugggcagcuggguggg

SEQ ID NO: 25341 - RNA, 20 nt, Artificial Sequence
  targeting sequence with TTCN PAM
ucccaccuguccagagguug

SEQ ID NO: 25342 - RNA, 20 nt, Artificial Sequence
  targeting sequence with TTCN PAM
agcucccagaaguaggaagu

SEQ ID NO: 25343 - RNA, 20 nt, Artificial Sequence
  targeting sequence with TTCN PAM
gggagcuggaaauagccucc

SEQ ID NO: 25344 - RNA, 20 nt, Artificial Sequence
  targeting sequence with TTCN PAM
uacuucugggagcuggaaau

SEQ ID NO: 25345 - RNA, 20 nt, Artificial Sequence
  targeting sequence with TTCN PAM
gacucacuuccuacuucugg

SEQ ID NO: 25346 - RNA, 20 nt, Artificial Sequence
  targeting sequence with TTCN PAM
gugcaggucucagccgucuc

SEQ ID NO: 25347 - RNA, 20 nt, Artificial Sequence
  targeting sequence with TTCN PAM
ugccacccuggguggugguc

SEQ ID NO: 25348 - RNA, 20 nt, Artificial Sequence
  targeting sequence with TTCN PAM
ucuaggccuccuuccugcca

SEQ ID NO: 25349 - RNA, 20 nt, Artificial Sequence
  targeting sequence with TTCN PAM
cuccuauccucuuccucuag

SEQ ID NO: 25350 - RNA, 20 nt, Artificial Sequence
  targeting sequence with TTCN PAM
gcaggggccccacagggcug

SEQ ID NO: 25351 - RNA, 20 nt, Artificial Sequence
  targeting sequence with TTCN PAM
ucagcacagaugcagccacc

SEQ ID NO: 25352 - RNA, 20 nt, Artificial Sequence
  targeting sequence with TTCN PAM
uggugggccccagguguggc

SEQ ID NO: 25353 - RNA, 20 nt, Artificial Sequence
  targeting sequence with TTCN PAM
ccauccucacucgagaggcu

SEQ ID NO: 25354 - RNA, 20 nt, Artificial Sequence
  targeting sequence with TTCN PAM
cagcucuggcaccaaaaggg

SEQ ID NO: 25355 - RNA, 20 nt, Artificial Sequence
  targeting sequence with TTCN PAM
aaacuggcugggugcagugg

SEQ ID NO: 25356 - RNA, 20 nt, Artificial Sequence
  targeting sequence with TTCN PAM
uuuuuugugucugaauuuuc

SEQ ID NO: 25357 - RNA, 20 nt, Artificial Sequence
  targeting sequence with TTCN PAM
gacacaaaaaaagaaaaacu

SEQ ID NO: 25358 - RNA, 20 nt, Artificial Sequence
  targeting sequence with TTCN PAM
aaguuuuccucaaagaauau

SEQ ID NO: 25359 - RNA, 20 nt, Artificial Sequence
  targeting sequence with TTCN PAM
ucaaagaauauguauuauuu

SEQ ID NO: 25360 - RNA, 20 nt, Artificial Sequence
  targeting sequence with TTCN PAM
uugaggaaaacuuagaaaau

SEQ ID NO: 25361 - RNA, 20 nt, Artificial Sequence
  targeting sequence with TTCN PAM
guuaaaaaaaacauggaggc

SEQ ID NO: 25362 - RNA, 20 nt, Artificial Sequence
  targeting sequence with TTCN PAM
gccuccauguuuuuuuuaac

SEQ ID NO: 25363 - RNA, 20 nt, Artificial Sequence
  targeting sequence with TTCN PAM
gaccugcuguaaauuacacg

SEQ ID NO: 25364 - RNA, 20 nt, Artificial Sequence
  targeting sequence with TTCN PAM
cuuccauuugugugacccca

SEQ ID NO: 25365 - RNA, 20 nt, Artificial Sequence
  targeting sequence with TTCN PAM
auuugugugaccccaggccc

SEQ ID NO: 25366 - RNA, 20 nt, Artificial Sequence
  targeting sequence with TTCN PAM
cccagcauccuccccaaggg

SEQ ID NO: 25367 - RNA, 20 nt, Artificial Sequence
  targeting sequence with TTCN PAM
gcaccgggaguugaauggug

SEQ ID NO: 25368 - RNA, 20 nt, Artificial Sequence
  targeting sequence with TTCN PAM
ugcccuugcuaagcaaaggc

SEQ ID NO: 25369 - RNA, 20 nt, Artificial Sequence
  targeting sequence with TTCN PAM
cugauacauggggauaacag

SEQ ID NO: 25370 - RNA, 20 nt, Artificial Sequence
  targeting sequence with TTCN PAM
uucucugauacauggggaua

SEQ ID NO: 25371 - RNA, 20 nt, Artificial Sequence
  targeting sequence with TTCN PAM
ggcuguguggccuugggcag

SEQ ID NO: 25372 - RNA, 20 nt, Artificial Sequence
  targeting sequence with TTCN PAM
gugccacugucccccacccc

SEQ ID NO: 25373 - RNA, 20 nt, Artificial Sequence
  targeting sequence with TTCN PAM
ccgcaucugcaccucccacc

SEQ ID NO: 25374 - RNA, 20 nt, Artificial Sequence
  targeting sequence with TTCN PAM
augcucggcucagcugucca

SEQ ID NO: 25375 - RNA, 20 nt, Artificial Sequence
  targeting sequence with TTCN PAM
gcccggugcugggugcuggc

SEQ ID NO: 25376 - RNA, 20 nt, Artificial Sequence
  targeting sequence with TTCN PAM
ccugugcacugggcauacug

SEQ ID NO: 25377 - RNA, 20 nt, Artificial Sequence
  targeting sequence with TTCN PAM
aucuuccccugugcacuggg

SEQ ID NO: 25378 - RNA, 20 nt, Artificial Sequence
  targeting sequence with TTCN PAM
ugagagcaagaagaggccac

SEQ ID NO: 25379 - RNA, 20 nt, Artificial Sequence
  targeting sequence with TTCN PAM
ugcucucaugaaguugcauu

SEQ ID NO: 25380 - RNA, 20 nt, Artificial Sequence
  targeting sequence with TTCN PAM
uggaggaggugaugccuaac

SEQ ID NO: 25381 - RNA, 20 nt, Artificial Sequence
  targeting sequence with TTCN PAM
ggcagggagaggaggaaaca

SEQ ID NO: 25382 - RNA, 20 nt, Artificial Sequence
  targeting sequence with TTCN PAM
uccucucccugccugaacua

SEQ ID NO: 25383 - RNA, 20 nt, Artificial Sequence
  targeting sequence with TTCN PAM
ugccucugggucuuugcaca

SEQ ID NO: 25384 - RNA, 20 nt, Artificial Sequence
  targeting sequence with TTCN PAM
cuacugcuggcccugccuug

SEQ ID NO: 25385 - RNA, 20 nt, Artificial Sequence
  targeting sequence with TTCN PAM
ggucugcagaggagccggca

SEQ ID NO: 25386 - RNA, 20 nt, Artificial Sequence
  targeting sequence with TTCN PAM
accucgccuuccggucugca

SEQ ID NO: 25387 - RNA, 20 nt, Artificial Sequence
  targeting sequence with TTCN PAM
uugagagcugugggacugga

SEQ ID NO: 25388 - RNA, 20 nt, Artificial Sequence
  targeting sequence with TTCN PAM
cuucauugagagcuguggga

SEQ ID NO: 25389 - RNA, 20 nt, Artificial Sequence
  targeting sequence with TTCN PAM
aagcaguuucucuucauuga

SEQ ID NO: 25390 - RNA, 20 nt, Artificial Sequence
  targeting sequence with TTCN PAM
uuccaagcaguuucucuuca

SEQ ID NO: 25391 - RNA, 20 nt, Artificial Sequence
  targeting sequence with TTCN PAM
uugucuccacucccagaucc

SEQ ID NO: 25392 - RNA, 20 nt, Artificial Sequence
  targeting sequence with TTCN PAM
ggcaggaucugggaguggag

SEQ ID NO: 25393 - RNA, 20 nt, Artificial Sequence
  targeting sequence with TTCN PAM
aggagggggauugaacggug

SEQ ID NO: 25394 - RNA, 20 nt, Artificial Sequence
  targeting sequence with TTCN PAM
aucccccuccuugaaagccu

SEQ ID NO: 25395 - RNA, 20 nt, Artificial Sequence
  targeting sequence with TTCN PAM
ccaccgcccacggggguccg

SEQ ID NO: 25396 - RNA, 20 nt, Artificial Sequence
  targeting sequence with TTCN PAM
cugggugguggagugggcaa

SEQ ID NO: 25397 - RNA, 20 nt, Artificial Sequence
  targeting sequence with TTCN PAM
cuaauaacuucaguuaguuc

SEQ ID NO: 25398 - RNA, 20 nt, Artificial Sequence
  targeting sequence with TTCN PAM
guuaguucccugccagcccu

SEQ ID NO: 25399 - RNA, 20 nt, Artificial Sequence
  targeting sequence with TTCN PAM
cugccagcccuggaggcagg

SEQ ID NO: 25400 - RNA, 20 nt, Artificial Sequence
  targeting sequence with TTCN PAM
caggcaucaaagggugugcc

SEQ ID NO: 25401 - RNA, 20 nt, Artificial Sequence
  targeting sequence with TTCN PAM
caucccagcucugcugugug

SEQ ID NO: 25402 - RNA, 20 nt, Artificial Sequence
  targeting sequence with TTCN PAM
ggccccagagcccacuagcu

SEQ ID NO: 25403 - RNA, 20 nt, Artificial Sequence
  targeting sequence with TTCN PAM
uuaacugccccuagagcccu

SEQ ID NO: 25404 - RNA, 20 nt, Artificial Sequence
  targeting sequence with TTCN PAM
ucuucauuaacugccccuag

SEQ ID NO: 25405 - RNA, 20 nt, Artificial Sequence
  targeting sequence with TTCN PAM
cccgccccacacaugcagcu

SEQ ID NO: 25406 - RNA, 20 nt, Artificial Sequence
  targeting sequence with TTCN PAM
agggacagggagcucacucc

SEQ ID NO: 25407 - RNA, 20 nt, Artificial Sequence
  targeting sequence with TTCN PAM
agcaaggggacauaugugug

SEQ ID NO: 25408 - RNA, 20 nt, Artificial Sequence
  targeting sequence with TTCN PAM
uaaucacugaccgggagacc

SEQ ID NO: 25409 - RNA, 20 nt, Artificial Sequence
  targeting sequence with TTCN PAM
agagccuccuggucucccgg

SEQ ID NO: 25410 - RNA, 20 nt, Artificial Sequence
  targeting sequence with TTCN PAM
ccuccaguccugccccacca

SEQ ID NO: 25411 - RNA, 20 nt, Artificial Sequence
  targeting sequence with TTCN PAM
auggucuucaccuccagucc

SEQ ID NO: 25412 - RNA, 20 nt, Artificial Sequence
  targeting sequence with TTCN PAM
uagaaagaagcuuccggcuc

SEQ ID NO: 25413 - RNA, 20 nt, Artificial Sequence
  targeting sequence with TTCN PAM
aggaaaggcugagguugugg

SEQ ID NO: 25414 - RNA, 20 nt, Artificial Sequence
  targeting sequence with TTCN PAM
uucuaggaaaggcugagguu

SEQ ID NO: 25415 - RNA, 20 nt, Artificial Sequence
  targeting sequence with TTCN PAM
ggcuccugcucagccugggu

SEQ ID NO: 25416 - RNA, 20 nt, Artificial Sequence
  targeting sequence with TTCN PAM
uccccacccaggcugagcag

SEQ ID NO: 25417 - RNA, 20 nt, Artificial Sequence
  targeting sequence with TTCN PAM
cacgguggcccccaucaaug

SEQ ID NO: 25418 - RNA, 20 nt, Artificial Sequence
  targeting sequence with TTCN PAM
uggauacugaucucagaugg

SEQ ID NO: 25419 - RNA, 20 nt, Artificial Sequence
  targeting sequence with TTCN PAM
caguccccauagugcugucg

SEQ ID NO: 25420 - RNA, 20 nt, Artificial Sequence
  targeting sequence with TTCN PAM
cccuccugucuucacagucc

SEQ ID NO: 25421 - RNA, 20 nt, Artificial Sequence
  targeting sequence with TTCN PAM
ccuucucccuccugucuuca

SEQ ID NO: 25422 - RNA, 20 nt, Artificial Sequence
  targeting sequence with TTCN PAM
ccuuccccuucucccuccug

SEQ ID NO: 25423 - RNA, 20 nt, Artificial Sequence
  targeting sequence with TTCN PAM
cuccuguggccguccuguuc

SEQ ID NO: 25424 - RNA, 20 nt, Artificial Sequence
  targeting sequence with TTCN PAM
agcacuaaggugcccugggg

SEQ ID NO: 25425 - RNA, 20 nt, Artificial Sequence
  targeting sequence with TTCN PAM
auugccccacaguccuccag

SEQ ID NO: 25426 - RNA, 20 nt, Artificial Sequence
  targeting sequence with TTCN PAM
acuucccuccaggguugacc

SEQ ID NO: 25427 - RNA, 20 nt, Artificial Sequence
  targeting sequence with TTCN PAM
cuccaggguugaccucagca

SEQ ID NO: 25428 - RNA, 20 nt, Artificial Sequence
  targeting sequence with TTCN PAM
cagagccaaggccggaagca

SEQ ID NO: 25429 - RNA, 20 nt, Artificial Sequence
  targeting sequence with TTCN PAM
ggccuuggcucugggaaaag

SEQ ID NO: 25430 - RNA, 20 nt, Artificial Sequence
  targeting sequence with TTCN PAM
ggcugggcuggggcuccggg

SEQ ID NO: 25431 - RNA, 20 nt, Artificial Sequence
  targeting sequence with TTCN PAM
gccucgccagcccggagccc

SEQ ID NO: 25432 - RNA, 20 nt, Artificial Sequence
  targeting sequence with TTCN PAM
ucccggugggggagccugac

SEQ ID NO: 25433 - RNA, 20 nt, Artificial Sequence
  targeting sequence with TTCN PAM
uccuuccucccgguggggga

SEQ ID NO: 25434 - RNA, 20 nt, Artificial Sequence
  targeting sequence with TTCN PAM
uccuuccuccuuccucccgg

SEQ ID NO: 25435 - RNA, 20 nt, Artificial Sequence
  targeting sequence with TTCN PAM
caccuccagccuugccuucc

SEQ ID NO: 25436 - RNA, 20 nt, Artificial Sequence
  targeting sequence with TTCN PAM
ucacccccagaggcugggcu

SEQ ID NO: 25437 - RNA, 20 nt, Artificial Sequence
  targeting sequence with TTCN PAM
ucagccacugagcgccuacu

SEQ ID NO: 25438 - RNA, 20 nt, Artificial Sequence
  targeting sequence with TTCN PAM
cucagccggggcucaggccc

SEQ ID NO: 25439 - RNA, 20 nt, Artificial Sequence
  targeting sequence with TTCN PAM
uucugucuuaguccaaacug

SEQ ID NO: 25440 - RNA, 20 nt, Artificial Sequence
  targeting sequence with TTCN PAM
gucuuaguccaaacugugug

SEQ ID NO: 25441 - RNA, 20 nt, Artificial Sequence
  targeting sequence with TTCN PAM
aauguugaaacccccaauac

SEQ ID NO: 25442 - RNA, 20 nt, Artificial Sequence
  targeting sequence with TTCN PAM
acauuugaauuugucggggg

SEQ ID NO: 25443 - RNA, 20 nt, Artificial Sequence
  targeting sequence with TTCN PAM
uuaaguuaaaaugagauggu

SEQ ID NO: 25444 - RNA, 20 nt, Artificial Sequence
  targeting sequence with TTCN PAM
agaccagccuaggcaacaca

SEQ ID NO: 25445 - RNA, 20 nt, Artificial Sequence
  targeting sequence with TTCN PAM
caccucgguccucuaaguag

SEQ ID NO: 25446 - RNA, 20 nt, Artificial Sequence
  targeting sequence with TTCN PAM
ggagggugcaagugguacag

SEQ ID NO: 25447 - RNA, 20 nt, Artificial Sequence
  targeting sequence with TTCN PAM
ucucaguucuggagggugca

SEQ ID NO: 25448 - RNA, 20 nt, Artificial Sequence
  targeting sequence with TTCN PAM
guuguugagcgauccagucu

SEQ ID NO: 25449 - RNA, 20 nt, Artificial Sequence
  targeting sequence with TTCN PAM
ggaggcugcaaggccaaguc

SEQ ID NO: 25450 - RNA, 20 nt, Artificial Sequence
  targeting sequence with TTCN PAM
ggcuguguccucacaugauc

SEQ ID NO: 25451 - RNA, 20 nt, Artificial Sequence
  targeting sequence with TTCN PAM
cucacuuccugcauaucuga

SEQ ID NO: 25452 - RNA, 20 nt, Artificial Sequence
  targeting sequence with TTCN PAM
ugcauaucugaauccucagc

SEQ ID NO: 25453 - RNA, 20 nt, Artificial Sequence
  targeting sequence with TTCN PAM
gauaugcaggaagugaggga

SEQ ID NO: 25454 - RNA, 20 nt, Artificial Sequence
  targeting sequence with TTCN PAM
uuauuuuuuuuuuuuugaga

SEQ ID NO: 25455 - RNA, 20 nt, Artificial Sequence
  targeting sequence with TTCN PAM
uaggcucaagccauccucca

SEQ ID NO: 25456 - RNA, 20 nt, Artificial Sequence
  targeting sequence with TTCN PAM
cuuuggcucuccgcuccagc

SEQ ID NO: 25457 - RNA, 20 nt, Artificial Sequence
  targeting sequence with TTCN PAM
gccugucaugcccuuuccag

SEQ ID NO: 25458 - RNA, 20 nt, Artificial Sequence
  targeting sequence with TTCN PAM
agaucuccccagggcugccg

SEQ ID NO: 25459 - RNA, 20 nt, Artificial Sequence
  targeting sequence with TTCN PAM
uaucccucagguuucugcuc

SEQ ID NO: 25460 - RNA, 20 nt, Artificial Sequence
  targeting sequence with TTCN PAM
gcucaaauaucccccuccaa

SEQ ID NO: 25461 - RNA, 20 nt, Artificial Sequence
  targeting sequence with TTCN PAM
ccagggcaggggauaugucu

SEQ ID NO: 25462 - RNA, 20 nt, Artificial Sequence
  targeting sequence with TTCN PAM
gcaaaccuuuacugugcacc

SEQ ID NO: 25463 - RNA, 20 nt, Artificial Sequence
  targeting sequence with TTCN PAM
cacgcagcaccuguguucac

SEQ ID NO: 25464 - RNA, 20 nt, Artificial Sequence
  targeting sequence with TTCN PAM
ccgcccccuuccccaucugu

SEQ ID NO: 25465 - RNA, 20 nt, Artificial Sequence
  targeting sequence with TTCN PAM
ccaucugucuuccagugauu

SEQ ID NO: 25466 - RNA, 20 nt, Artificial Sequence
  targeting sequence with TTCN PAM
agugauuccuccagaggcug

SEQ ID NO: 25467 - RNA, 20 nt, Artificial Sequence
  targeting sequence with TTCN PAM
uccagaggcugcuuguuugg

SEQ ID NO: 25468 - RNA, 20 nt, Artificial Sequence
  targeting sequence with TTCN PAM
caaacaagcagccucuggag

SEQ ID NO: 25469 - RNA, 20 nt, Artificial Sequence
  targeting sequence with TTCN PAM
ucccaaacaagcagccucug

SEQ ID NO: 25470 - RNA, 20 nt, Artificial Sequence
  targeting sequence with TTCN PAM
accugguccuaccugcuuag

SEQ ID NO: 25471 - RNA, 20 nt, Artificial Sequence
  targeting sequence with TTCN PAM
uaugcucaaguccuccucag

SEQ ID NO: 25472 - RNA, 20 nt, Artificial Sequence
  targeting sequence with TTCN PAM
ccuggggacucgugggguag

SEQ ID NO: 25473 - RNA, 20 nt, Artificial Sequence
  targeting sequence with TTCN PAM
cucauccugcucccagaugg

SEQ ID NO: 25474 - RNA, 20 nt, Artificial Sequence
  targeting sequence with TTCN PAM
ugcccuucccucauccugcu

SEQ ID NO: 25475 - RNA, 20 nt, Artificial Sequence
  targeting sequence with TTCN PAM
cucuuugcucagucaacccu

SEQ ID NO: 25476 - RNA, 20 nt, Artificial Sequence
  targeting sequence with TTCN PAM
agugggaguagggcugucuc

SEQ ID NO: 25477 - RNA, 20 nt, Artificial Sequence
  targeting sequence with TTCN PAM
gucucagccuuucaaguggg

SEQ ID NO: 25478 - RNA, 20 nt, Artificial Sequence
  targeting sequence with TTCN PAM
ccccugccccuguggcucca

SEQ ID NO: 25479 - RNA, 20 nt, Artificial Sequence
  targeting sequence with TTCN PAM
cauuucaccccugccccugu

SEQ ID NO: 25480 - RNA, 20 nt, Artificial Sequence
  targeting sequence with TTCN PAM
ucaaaaaaagucaaaugugg

SEQ ID NO: 25481 - RNA, 20 nt, Artificial Sequence
  targeting sequence with TTCN PAM
aaaaaagucaaauguggcug

SEQ ID NO: 25482 - RNA, 20 nt, Artificial Sequence
  targeting sequence with TTCN PAM
ccguguuagccaggcugguc

SEQ ID NO: 25483 - RNA, 20 nt, Artificial Sequence
  targeting sequence with TTCN PAM
ccugccucagccuccugagu

SEQ ID NO: 25484 - RNA, 20 nt, Artificial Sequence
  targeting sequence with TTCN PAM
ugccauucuccugccucagc

SEQ ID NO: 25485 - RNA, 20 nt, Artificial Sequence
  targeting sequence with TTCN PAM
aauaucuagacgugggauug

SEQ ID NO: 25486 - RNA, 20 nt, Artificial Sequence
  targeting sequence with TTCN PAM
gcaaucuggaaacaagccaa

SEQ ID NO: 25487 - RNA, 20 nt, Artificial Sequence
  targeting sequence with TTCN PAM
agauugcagaaauuaucaau

SEQ ID NO: 25488 - RNA, 20 nt, Artificial Sequence
  targeting sequence with TTCN PAM
ccagcccagggacacuuggc

SEQ ID NO: 25489 - RNA, 20 nt, Artificial Sequence
  targeting sequence with TTCN PAM
auuguauggaggccuccaug

SEQ ID NO: 25490 - RNA, 20 nt, Artificial Sequence
  targeting sequence with TTCN PAM
uuccauuguauggaggccuc

SEQ ID NO: 25491 - RNA, 20 nt, Artificial Sequence
  targeting sequence with TTCN PAM
uuuucguuccauuguaugga

SEQ ID NO: 25492 - RNA, 20 nt, Artificial Sequence
  targeting sequence with TTCN PAM
agccuggcuuggagaugcau

SEQ ID NO: 25493 - RNA, 20 nt, Artificial Sequence
  targeting sequence with TTCN PAM
aaacagcauguacaugggau

SEQ ID NO: 25494 - RNA, 20 nt, Artificial Sequence
  targeting sequence with TTCN PAM
cagucagucccuccccccag

SEQ ID NO: 25495 - RNA, 20 nt, Artificial Sequence
  targeting sequence with TTCN PAM
cugguggcccuucccaguca

SEQ ID NO: 25496 - RNA, 20 nt, Artificial Sequence
  targeting sequence with TTCN PAM
gguugcugggaauguuccau

SEQ ID NO: 25497 - RNA, 20 nt, Artificial Sequence
  targeting sequence with TTCN PAM
cagcaaccagaaaauucccu

SEQ ID NO: 25498 - RNA, 20 nt, Artificial Sequence
  targeting sequence with TTCN PAM
augucuuguucagagcauuu

SEQ ID NO: 25499 - RNA, 20 nt, Artificial Sequence
  targeting sequence with TTCN PAM
gagcauuuacaggguauaaa

SEQ ID NO: 25500 - RNA, 20 nt, Artificial Sequence
  targeting sequence with TTCN PAM
cauuugagaucugaggccac

SEQ ID NO: 25501 - RNA, 20 nt, Artificial Sequence
  targeting sequence with TTCN PAM
ccugauguaaauuauaacuc

SEQ ID NO: 25502 - RNA, 20 nt, Artificial Sequence
  targeting sequence with TTCN PAM
uugaguuauaauuuacauca

SEQ ID NO: 25503 - RNA, 20 nt, Artificial Sequence
  targeting sequence with TTCN PAM
auacucgccagccugugcca

SEQ ID NO: 25504 - RNA, 20 nt, Artificial Sequence
  targeting sequence with TTCN PAM
uagccuggggacagagcugg

SEQ ID NO: 25505 - RNA, 20 nt, Artificial Sequence
  targeting sequence with TTCN PAM
gaccggcaggggugggaggg

SEQ ID NO: 25506 - RNA, 20 nt, Artificial Sequence
  targeting sequence with TTCN PAM
cagcaccccagccugggccc

SEQ ID NO: 25507 - RNA, 20 nt, Artificial Sequence
  targeting sequence with TTCN PAM
ggccucucucugcggggcgg

SEQ ID NO: 25508 - RNA, 20 nt, Artificial Sequence
  targeting sequence with TTCN PAM
guuccggcuccgccucgucc

SEQ ID NO: 25509 - RNA, 20 nt, Artificial Sequence
  targeting sequence with TTCN PAM
ggcuccgccucguccucccg

SEQ ID NO: 25510 - RNA, 20 nt, Artificial Sequence
  targeting sequence with TTCN PAM
ccggcugcggguacaccccc

SEQ ID NO: 25511 - RNA, 20 nt, Artificial Sequence
  targeting sequence with TTCN PAM
cgagccccccgggcccucgc

SEQ ID NO: 25512 - RNA, 20 nt, Artificial Sequence
  targeting sequence with TTCN PAM
ggguggagcagcgagggccc

SEQ ID NO: 25513 - RNA, 20 nt, Artificial Sequence
  targeting sequence with TTCN PAM
cuggccgggcaucacuugcg

SEQ ID NO: 25514 - RNA, 20 nt, Artificial Sequence
  targeting sequence with TTCN PAM
cccccuugggcccuugagcg

SEQ ID NO: 25515 - RNA, 20 nt, Artificial Sequence
  targeting sequence with TTCN PAM
aagacgcucaagggcccaag

SEQ ID NO: 25516 - RNA, 20 nt, Artificial Sequence
  targeting sequence with TTCN PAM
uuuaguccccagcuuugcuc

SEQ ID NO: 25517 - RNA, 20 nt, Artificial Sequence
  targeting sequence with TTCN PAM
ugcucucgccaaauuggccg

SEQ ID NO: 25518 - RNA, 20 nt, Artificial Sequence
  targeting sequence with TTCN PAM
cgguguguccucagugccug

SEQ ID NO: 25519 - RNA, 20 nt, Artificial Sequence
  targeting sequence with TTCN PAM
ggacagggcccugaggacag

SEQ ID NO: 25520 - RNA, 20 nt, Artificial Sequence
  targeting sequence with TTCN PAM
uugccgcggacucgaggcug

SEQ ID NO: 25521 - RNA, 20 nt, Artificial Sequence
  targeting sequence with TTCN PAM
uucauugccgcggacucgag

SEQ ID NO: 25522 - RNA, 20 nt, Artificial Sequence
  targeting sequence with TTCN PAM
auugcacagauggggaggcg

SEQ ID NO: 25523 - RNA, 20 nt, Artificial Sequence
  targeting sequence with TTCN PAM
ccuccccaucugugcaauug

SEQ ID NO: 25524 - RNA, 20 nt, Artificial Sequence
  targeting sequence with TTCN PAM
ugccggcgcauagccuccca

SEQ ID NO: 25525 - RNA, 20 nt, Artificial Sequence
  targeting sequence with TTCN PAM
uggauuugagucucaacucc

SEQ ID NO: 25526 - RNA, 20 nt, Artificial Sequence
  targeting sequence with TTCN PAM
uucuuggauuugagucucaa

SEQ ID NO: 25527 - RNA, 20 nt, Artificial Sequence
  targeting sequence with TTCN PAM
caguaggcaagugguccaag

SEQ ID NO: 25528 - RNA, 20 nt, Artificial Sequence
  targeting sequence with TTCN PAM
auuuuucucaguaggcaagu

SEQ ID NO: 25529 - RNA, 20 nt, Artificial Sequence
  targeting sequence with TTCN PAM
cgacuuccauuuuucucagu

SEQ ID NO: 25530 - RNA, 20 nt, Artificial Sequence
  targeting sequence with TTCN PAM
gucuccgggccucagcuucc

SEQ ID NO: 25531 - RNA, 20 nt, Artificial Sequence
  targeting sequence with TTCN PAM
cagguuguagaaagcaucag

SEQ ID NO: 25532 - RNA, 20 nt, Artificial Sequence
  targeting sequence with TTCN PAM
acaaccugggaagcugaggc

SEQ ID NO: 25533 - RNA, 20 nt, Artificial Sequence
  targeting sequence with TTCN PAM
gagccuccaacccugaugcu

SEQ ID NO: 25534 - RNA, 20 nt, Artificial Sequence
  targeting sequence with TTCN PAM
ggcuccucucaagccaagau

SEQ ID NO: 25535 - RNA, 20 nt, Artificial Sequence
  targeting sequence with TTCN PAM
uuuugguugugcaagaaaug

SEQ ID NO: 25536 - RNA, 20 nt, Artificial Sequence
  targeting sequence with TTCN PAM
ugcacaaccaaaaugaaguc

SEQ ID NO: 25537 - RNA, 20 nt, Artificial Sequence
  targeting sequence with TTCN PAM
cagaggcagagggaccuaag

SEQ ID NO: 25538 - RNA, 20 nt, Artificial Sequence
  targeting sequence with TTCN PAM
agcuuaggucccucugccuc

SEQ ID NO: 25539 - RNA, 20 nt, Artificial Sequence
  targeting sequence with TTCN PAM
ugccuacgccgguuugauug

SEQ ID NO: 25540 - RNA, 20 nt, Artificial Sequence
  targeting sequence with TTCN PAM
aggagcgcacccucuguguc

SEQ ID NO: 25541 - RNA, 20 nt, Artificial Sequence
  targeting sequence with TTCN PAM
aaacaaaacguaagccuggu

SEQ ID NO: 25542 - RNA, 20 nt, Artificial Sequence
  targeting sequence with TTCN PAM
aaguaacagaaaagccguga

SEQ ID NO: 25543 - RNA, 20 nt, Artificial Sequence
  targeting sequence with TTCN PAM
guuacuuugaaauuauuuca

SEQ ID NO: 25544 - RNA, 20 nt, Artificial Sequence
  targeting sequence with TTCN PAM
cacggcuuuucuguuacuuu

SEQ ID NO: 25545 - RNA, 20 nt, Artificial Sequence
  targeting sequence with TTCN PAM
gagaacugccucccuuauua

SEQ ID NO: 25546 - RNA, 20 nt, Artificial Sequence
  targeting sequence with TTCN PAM
cggaacuauucucacggcuu

SEQ ID NO: 25547 - RNA, 20 nt, Artificial Sequence
  targeting sequence with TTCN PAM
ccaagcuuuaacauucugcu

SEQ ID NO: 25548 - RNA, 20 nt, Artificial Sequence
  targeting sequence with TTCN PAM
gcuccccagcccuugcauau

SEQ ID NO: 25549 - RNA, 20 nt, Artificial Sequence
  targeting sequence with TTCN PAM
agcccccauugcaagcaucg

SEQ ID NO: 25550 - RNA, 20 nt, Artificial Sequence
  targeting sequence with TTCN PAM
agggccaucgcgccugcaac

SEQ ID NO: 25551 - RNA, 20 nt, Artificial Sequence
  targeting sequence with TTCN PAM
ugggcaauacacauuggagg

SEQ ID NO: 25552 - RNA, 20 nt, Artificial Sequence
  targeting sequence with TTCN PAM
auugcacaaccccagugguu

SEQ ID NO: 25553 - RNA, 20 nt, Artificial Sequence
  targeting sequence with TTCN PAM
agaucgagugauuuaaccau

SEQ ID NO: 25554 - RNA, 20 nt, Artificial Sequence
  targeting sequence with TTCN PAM
cauccccauccaggagccac

SEQ ID NO: 25555 - RNA, 20 nt, Artificial Sequence
  targeting sequence with TTCN PAM
cgccauucuccugccucagc

SEQ ID NO: 25556 - RNA, 20 nt, Artificial Sequence
  targeting sequence with TTCN PAM
ccugccucagccucccgagu

SEQ ID NO: 25557 - RNA, 20 nt, Artificial Sequence
  targeting sequence with TTCN PAM
ccguguuagccagucugguc

SEQ ID NO: 25558 - RNA, 20 nt, Artificial Sequence
  targeting sequence with TTCN PAM
ccuuuuucauuuuguuauuu

SEQ ID NO: 25559 - RNA, 20 nt, Artificial Sequence
  targeting sequence with TTCN PAM
uuuuguuauuuuauuucguu

SEQ ID NO: 25560 - RNA, 20 nt, Artificial Sequence
  targeting sequence with TTCN PAM
uuuguuuguuuugagacagg

SEQ ID NO: 25561 - RNA, 20 nt, Artificial Sequence
  targeting sequence with TTCN PAM
aggcugcagugagccaugcu

SEQ ID NO: 25562 - RNA, 20 nt, Artificial Sequence
  targeting sequence with TTCN PAM
caaggaguuggugccuuuug

SEQ ID NO: 25563 - RNA, 20 nt, Artificial Sequence
  targeting sequence with TTCN PAM
ccaaagcugccuucucaagg

SEQ ID NO: 25564 - RNA, 20 nt, Artificial Sequence
  targeting sequence with TTCN PAM
uuaacuuuuacuauggaaaa

SEQ ID NO: 25565 - RNA, 20 nt, Artificial Sequence
  targeting sequence with TTCN PAM
auaguaaaaguuaaagaaau

SEQ ID NO: 25566 - RNA, 20 nt, Artificial Sequence
  targeting sequence with TTCN PAM
uuguagaggucucucuacuu

SEQ ID NO: 25567 - RNA, 20 nt, Artificial Sequence
  targeting sequence with TTCN PAM
uaaugauggauuacuaugga

SEQ ID NO: 25568 - RNA, 20 nt, Artificial Sequence
  targeting sequence with TTCN PAM
gcccaaaauccauaguaauc

SEQ ID NO: 25569 - RNA, 20 nt, Artificial Sequence
  targeting sequence with TTCN PAM
aaggaauaauuguguugcau

SEQ ID NO: 25570 - RNA, 20 nt, Artificial Sequence
  targeting sequence with TTCN PAM
uuugaauuuucugcccaaaa

SEQ ID NO: 25571 - RNA, 20 nt, Artificial Sequence
  targeting sequence with TTCN PAM
cuuugcuuauuuaugugaca

SEQ ID NO: 25572 - RNA, 20 nt, Artificial Sequence
  targeting sequence with TTCN PAM
cagugcuuaccucuauaaaa

SEQ ID NO: 25573 - RNA, 20 nt, Artificial Sequence
  targeting sequence with TTCN PAM
cauuuuuauagagguaagca

SEQ ID NO: 25574 - RNA, 20 nt, Artificial Sequence
  targeting sequence with TTCN PAM
aauuucucauuuuuauagag

SEQ ID NO: 25575 - RNA, 20 nt, Artificial Sequence
  targeting sequence with TTCN PAM
gacacgcgccacuaugcccg

SEQ ID NO: 25576 - RNA, 20 nt, Artificial Sequence
  targeting sequence with TTCN PAM
gguaaguuauuacaaauaac

SEQ ID NO: 25577 - RNA, 20 nt, Artificial Sequence
  targeting sequence with TTCN PAM
ggcaugagaauacaucauug

SEQ ID NO: 25578 - RNA, 20 nt, Artificial Sequence
  targeting sequence with TTCN PAM
caugccugaaaguaucuuau

SEQ ID NO: 25579 - RNA, 20 nt, Artificial Sequence
  targeting sequence with TTCN PAM
acugcccccacaaacuuuga

SEQ ID NO: 25580 - RNA, 20 nt, Artificial Sequence
  targeting sequence with TTCN PAM
auuccacugcccccacaaac

SEQ ID NO: 25581 - RNA, 20 nt, Artificial Sequence
  targeting sequence with TTCN PAM
aagagaaauaaacugaugua

SEQ ID NO: 25582 - RNA, 20 nt, Artificial Sequence
  targeting sequence with TTCN PAM
cuuagaaacucguauucaau

SEQ ID NO: 25583 - RNA, 20 nt, Artificial Sequence
  targeting sequence with TTCN PAM
uuuaaaaaaaggccagggcc

SEQ ID NO: 25584 - RNA, 20 nt, Artificial Sequence
  targeting sequence with TTCN PAM
agaccagccuggccaacaug

SEQ ID NO: 25585 - RNA, 20 nt, Artificial Sequence
  targeting sequence with TTCN PAM
ccauguuggccaggcugguc

SEQ ID NO: 25586 - RNA, 20 nt, Artificial Sequence
  targeting sequence with TTCN PAM
uuuuagagacaaggucucac

SEQ ID NO: 25587 - RNA, 20 nt, Artificial Sequence
  targeting sequence with TTCN PAM
uauuuauuuauucauuuuag

SEQ ID NO: 25588 - RNA, 20 nt, Artificial Sequence
  targeting sequence with TTCN PAM
ucuagguaccuguucuauuu

SEQ ID NO: 25589 - RNA, 20 nt, Artificial Sequence
  targeting sequence with TTCN PAM
auuuuuuuuuucuuugaguu

SEQ ID NO: 25590 - RNA, 20 nt, Artificial Sequence
  targeting sequence with TTCN PAM
uugaguuuuuuuaauaaaau

SEQ ID NO: 25591 - RNA, 20 nt, Artificial Sequence
  targeting sequence with TTCN PAM
aaggcuggauccuagccuug

SEQ ID NO: 25592 - RNA, 20 nt, Artificial Sequence
  targeting sequence with TTCN PAM
ccgucuucaaaugcaggccg

SEQ ID NO: 25593 - RNA, 20 nt, Artificial Sequence
  targeting sequence with TTCN PAM
gcaggggccuggagcugguc

SEQ ID NO: 25594 - RNA, 20 nt, Artificial Sequence
  targeting sequence with TTCN PAM
ccuggucaaagcccaaggcc

SEQ ID NO: 25595 - RNA, 20 nt, Artificial Sequence
  targeting sequence with TTCN PAM
acugcugccccacugucuuc

SEQ ID NO: 25596 - RNA, 20 nt, Artificial Sequence
  targeting sequence with TTCN PAM
guccacccagcuggaugaua

SEQ ID NO: 25597 - RNA, 20 nt, Artificial Sequence
  targeting sequence with TTCN PAM
ggcugccucuuuaaugcagc

SEQ ID NO: 25598 - RNA, 20 nt, Artificial Sequence
  targeting sequence with TTCN PAM
cuucuggcugccucuuuaau

SEQ ID NO: 25599 - RNA, 20 nt, Artificial Sequence
  targeting sequence with TTCN PAM
gcccaagccuggugaccuca

SEQ ID NO: 25600 - RNA, 20 nt, Artificial Sequence
  targeting sequence with TTCN PAM
ggagccuucugcccaagccu

SEQ ID NO: 25601 - RNA, 20 nt, Artificial Sequence
  targeting sequence with TTCN PAM
gguaugccucacagacaugu

SEQ ID NO: 25602 - RNA, 20 nt, Artificial Sequence
  targeting sequence with TTCN PAM
gguaaaaccagucuagcccc

SEQ ID NO: 25603 - RNA, 20 nt, Artificial Sequence
  targeting sequence with TTCN PAM
ugcucaggucuauccagacu

SEQ ID NO: 25604 - RNA, 20 nt, Artificial Sequence
  targeting sequence with TTCN PAM
caccugaccucuggcucaag

SEQ ID NO: 25605 - RNA, 20 nt, Artificial Sequence
  targeting sequence with TTCN PAM
ugugaacuacggggagugug

SEQ ID NO: 25606 - RNA, 20 nt, Artificial Sequence
  targeting sequence with TTCN PAM
caugaaacuaauucccaccu

SEQ ID NO: 25607 - RNA, 20 nt, Artificial Sequence
  targeting sequence with TTCN PAM
uuuaaaaaaaaaaaaucccu

SEQ ID NO: 25608 - RNA, 20 nt, Artificial Sequence
  targeting sequence with TTCN PAM
guucuuuuaaaaaaaaaaaa

SEQ ID NO: 25609 - RNA, 20 nt, Artificial Sequence
  targeting sequence with TTCN PAM
acuuaucaaaaaacugugaa

SEQ ID NO: 25610 - RNA, 20 nt, Artificial Sequence
  targeting sequence with TTCN PAM
caguuuuuugauaaguggaa

SEQ ID NO: 25611 - RNA, 20 nt, Artificial Sequence
  targeting sequence with TTCN PAM
ucaaacacccaacugauugg

SEQ ID NO: 25612 - RNA, 20 nt, Artificial Sequence
  targeting sequence with TTCN PAM
ggucaucccaaucaguuggg

SEQ ID NO: 25613 - RNA, 20 nt, Artificial Sequence
  targeting sequence with TTCN PAM
gguuucuucucaaagggcug

SEQ ID NO: 25614 - RNA, 20 nt, Artificial Sequence
  targeting sequence with TTCN PAM
ucucaaagggcuguaauuaa

SEQ ID NO: 25615 - RNA, 20 nt, Artificial Sequence
  targeting sequence with TTCN PAM
caaagggcuguaauuaaaca

SEQ ID NO: 25616 - RNA, 20 nt, Artificial Sequence
  targeting sequence with TTCN PAM
guuuaauuacagcccuuuga

SEQ ID NO: 25617 - RNA, 20 nt, Artificial Sequence
  targeting sequence with TTCN PAM
acaccuguaauggcuucucu

SEQ ID NO: 25618 - RNA, 20 nt, Artificial Sequence
  targeting sequence with TTCN PAM
cuuguagucacaagguaaac

SEQ ID NO: 25619 - RNA, 20 nt, Artificial Sequence
  targeting sequence with TTCN PAM
agauuucuugcaacuuggcc

SEQ ID NO: 25620 - RNA, 20 nt, Artificial Sequence
  targeting sequence with TTCN PAM
ugcaacuuggcccccacaua

SEQ ID NO: 25621 - RNA, 20 nt, Artificial Sequence
  targeting sequence with TTCN PAM
cacacauucuuucaggcacc

SEQ ID NO: 25622 - RNA, 20 nt, Artificial Sequence
  targeting sequence with TTCN PAM
uucaggcacccuaccaguca

SEQ ID NO: 25623 - RNA, 20 nt, Artificial Sequence
  targeting sequence with TTCN PAM
ggcacccuaccagucacuua

SEQ ID NO: 25624 - RNA, 20 nt, Artificial Sequence
  targeting sequence with TTCN PAM
agcaauggauaaggagccuu

SEQ ID NO: 25625 - RNA, 20 nt, Artificial Sequence
  targeting sequence with TTCN PAM
ccucugugguuuugcuaaua

SEQ ID NO: 25626 - RNA, 20 nt, Artificial Sequence
  targeting sequence with TTCN PAM
auuggagguauuagcaaaac

SEQ ID NO: 25627 - RNA, 20 nt, Artificial Sequence
  targeting sequence with TTCN PAM
gcucaucauaaagccaccau

SEQ ID NO: 25628 - RNA, 20 nt, Artificial Sequence
  targeting sequence with TTCN PAM
guccagauaccauggccucc

SEQ ID NO: 25629 - RNA, 20 nt, Artificial Sequence
  targeting sequence with TTCN PAM
cuauugcucuguuagaauug

SEQ ID NO: 25630 - RNA, 20 nt, Artificial Sequence
  targeting sequence with TTCN PAM
aacagagcaauagggaaagg

SEQ ID NO: 25631 - RNA, 20 nt, Artificial Sequence
  targeting sequence with TTCN PAM
uccucuuugcucccacacgu

SEQ ID NO: 25632 - RNA, 20 nt, Artificial Sequence
  targeting sequence with TTCN PAM
gccucuuuaccacauguauu

SEQ ID NO: 25633 - RNA, 20 nt, Artificial Sequence
  targeting sequence with TTCN PAM
uucuacuaaguuccuuuuuc

SEQ ID NO: 25634 - RNA, 20 nt, Artificial Sequence
  targeting sequence with TTCN PAM
acuaaguuccuuuuuccaca

SEQ ID NO: 25635 - RNA, 20 nt, Artificial Sequence
  targeting sequence with TTCN PAM
uuuuuccacagcccagucuu

SEQ ID NO: 25636 - RNA, 20 nt, Artificial Sequence
  targeting sequence with TTCN PAM
acagcccagucuuguauaga

SEQ ID NO: 25637 - RNA, 20 nt, Artificial Sequence
  targeting sequence with TTCN PAM
cagcccgcagggcuucuggc

SEQ ID NO: 25638 - RNA, 20 nt, Artificial Sequence
  targeting sequence with TTCN PAM
ggcagcgggacaucuaugug

SEQ ID NO: 25639 - RNA, 20 nt, Artificial Sequence
  targeting sequence with TTCN PAM
aggcuugggggucacauaga

SEQ ID NO: 25640 - RNA, 20 nt, Artificial Sequence
  targeting sequence with TTCN PAM
agcccuggauuucuaggcuu

SEQ ID NO: 25641 - RNA, 20 nt, Artificial Sequence
  targeting sequence with TTCN PAM
uccagcccuggauuucuagg

SEQ ID NO: 25642 - RNA, 20 nt, Artificial Sequence
  targeting sequence with TTCN PAM
uaaugacagaucauacuaga

SEQ ID NO: 25643 - RNA, 20 nt, Artificial Sequence
  targeting sequence with TTCN PAM
uuuuucacuucucacuggac

SEQ ID NO: 25644 - RNA, 20 nt, Artificial Sequence
  targeting sequence with TTCN PAM
cuucucacuggaccuauuuu

SEQ ID NO: 25645 - RNA, 20 nt, Artificial Sequence
  targeting sequence with TTCN PAM
cacuggaccuauuuuuaagu

SEQ ID NO: 25646 - RNA, 20 nt, Artificial Sequence
  targeting sequence with TTCN PAM
ucaaagagauucauacuuua

SEQ ID NO: 25647 - RNA, 20 nt, Artificial Sequence
  targeting sequence with TTCN PAM
aagagauucauacuuuauag

SEQ ID NO: 25648 - RNA, 20 nt, Artificial Sequence
  targeting sequence with TTCN PAM
uacuuuauagaagccaagca

SEQ ID NO: 25649 - RNA, 20 nt, Artificial Sequence
  targeting sequence with TTCN PAM
auaaaguaugaaucucuuug

SEQ ID NO: 25650 - RNA, 20 nt, Artificial Sequence
  targeting sequence with TTCN PAM
ugcuuggcuucuauaaagua

SEQ ID NO: 25651 - RNA, 20 nt, Artificial Sequence
  targeting sequence with TTCN PAM
ucccucucccuucccaaaau

SEQ ID NO: 25652 - RNA, 20 nt, Artificial Sequence
  targeting sequence with TTCN PAM
caaaauaacgggaaaguuua

SEQ ID NO: 25653 - RNA, 20 nt, Artificial Sequence
  targeting sequence with TTCN PAM
cguuauuuugggaagggaga

SEQ ID NO: 25654 - RNA, 20 nt, Artificial Sequence
  targeting sequence with TTCN PAM
caacauaaaugggagacaau

SEQ ID NO: 25655 - RNA, 20 nt, Artificial Sequence
  targeting sequence with TTCN PAM
acaguuggcuuuuuaaaucu

SEQ ID NO: 25656 - RNA, 20 nt, Artificial Sequence
  targeting sequence with TTCN PAM
gccuccuguauaaucagugc

SEQ ID NO: 25657 - RNA, 20 nt, Artificial Sequence
  targeting sequence with TTCN PAM
gguaugcuuauuggucauuu

SEQ ID NO: 25658 - RNA, 20 nt, Artificial Sequence
  targeting sequence with TTCN PAM
uuucuuuuuuuuuuuuugag

SEQ ID NO: 25659 - RNA, 20 nt, Artificial Sequence
  targeting sequence with TTCN PAM
uuuuuuuuuuuugagacaga

SEQ ID NO: 25660 - RNA, 20 nt, Artificial Sequence
  targeting sequence with TTCN PAM
uggguucacgccauucuccu

SEQ ID NO: 25661 - RNA, 20 nt, Artificial Sequence
  targeting sequence with TTCN PAM
cgccauucuccugccucagc

SEQ ID NO: 25662 - RNA, 20 nt, Artificial Sequence
  targeting sequence with TTCN PAM
ccugccucagccucccgagu

SEQ ID NO: 25663 - RNA, 20 nt, Artificial Sequence
  targeting sequence with TTCN PAM
aaagcugaaaggcagcuccu

SEQ ID NO: 25664 - RNA, 20 nt, Artificial Sequence
  targeting sequence with TTCN PAM
gcuuuggaaaauaugcaacu

SEQ ID NO: 25665 - RNA, 20 nt, Artificial Sequence
  targeting sequence with TTCN PAM
aaugaggagcugccuuucag

SEQ ID NO: 25666 - RNA, 20 nt, Artificial Sequence
  targeting sequence with TTCN PAM
gagagaguuccaaugaggag

SEQ ID NO: 25667 - RNA, 20 nt, Artificial Sequence
  targeting sequence with TTCN PAM
ucugacuguaccucaaagga

SEQ ID NO: 25668 - RNA, 20 nt, Artificial Sequence
  targeting sequence with TTCN PAM
uuugagguacagucagauga

SEQ ID NO: 25669 - RNA, 20 nt, Artificial Sequence
  targeting sequence with TTCN PAM
uguuccuuugagguacaguc

SEQ ID NO: 25670 - RNA, 20 nt, Artificial Sequence
  targeting sequence with TTCN PAM
gauuucauguuccuuugagg

SEQ ID NO: 25671 - RNA, 20 nt, Artificial Sequence
  targeting sequence with TTCN PAM
cugcauuugguuuuguuucu

SEQ ID NO: 25672 - RNA, 20 nt, Artificial Sequence
  targeting sequence with TTCN PAM
uguggucuucacugcauuug

SEQ ID NO: 25673 - RNA, 20 nt, Artificial Sequence
  targeting sequence with TTCN PAM
ucacuagccauguccaaaua

SEQ ID NO: 25674 - RNA, 20 nt, Artificial Sequence
  targeting sequence with TTCN PAM
gaacaggggagagagaagac

SEQ ID NO: 25675 - RNA, 20 nt, Artificial Sequence
  targeting sequence with TTCN PAM
gaauggaguaaaagucugau

SEQ ID NO: 25676 - RNA, 20 nt, Artificial Sequence
  targeting sequence with TTCN PAM
cucuccccuguucugaaugg

SEQ ID NO: 25677 - RNA, 20 nt, Artificial Sequence
  targeting sequence with TTCN PAM
cugacuagggucuucucucu

SEQ ID NO: 25678 - RNA, 20 nt, Artificial Sequence
  targeting sequence with TTCN PAM
uaaggagccaguagagugga

SEQ ID NO: 25679 - RNA, 20 nt, Artificial Sequence
  targeting sequence with TTCN PAM
acucuacuggcuccuuaaga

SEQ ID NO: 25680 - RNA, 20 nt, Artificial Sequence
  targeting sequence with TTCN PAM
uuacuaggacauacugagua

SEQ ID NO: 25681 - RNA, 20 nt, Artificial Sequence
  targeting sequence with TTCN PAM
uugguauacucaguaugucc

SEQ ID NO: 25682 - RNA, 20 nt, Artificial Sequence
  targeting sequence with TTCN PAM
auuccuugguauacucagua

SEQ ID NO: 25683 - RNA, 20 nt, Artificial Sequence
  targeting sequence with TTCN PAM
gucugcuccaauuuccauuc

SEQ ID NO: 25684 - RNA, 20 nt, Artificial Sequence
  targeting sequence with TTCN PAM
auuaucauaaacaauguaaa

SEQ ID NO: 25685 - RNA, 20 nt, Artificial Sequence
  targeting sequence with TTCN PAM
acaaccugaacaaucaccca

SEQ ID NO: 25686 - RNA, 20 nt, Artificial Sequence
  targeting sequence with TTCN PAM
gguuguagaaugcgcauuuu

SEQ ID NO: 25687 - RNA, 20 nt, Artificial Sequence
  targeting sequence with TTCN PAM
cucacccaggcuagaggcau

SEQ ID NO: 25688 - RNA, 20 nt, Artificial Sequence
  targeting sequence with TTCN PAM
ugguuuauuuguccaugccu

SEQ ID NO: 25689 - RNA, 20 nt, Artificial Sequence
  targeting sequence with TTCN PAM
uuuuaaagggaaugaauaca

SEQ ID NO: 25690 - RNA, 20 nt, Artificial Sequence
  targeting sequence with TTCN PAM
cuuuaaaaugaaacauuccu

SEQ ID NO: 25691 - RNA, 20 nt, Artificial Sequence
  targeting sequence with TTCN PAM
uucccuuuaaaaugaaacau

SEQ ID NO: 25692 - RNA, 20 nt, Artificial Sequence
  targeting sequence with TTCN PAM
uuucuuuuuuuuuuagagga

SEQ ID NO: 25693 - RNA, 20 nt, Artificial Sequence
  targeting sequence with TTCN PAM
uuuuuuuuuagaggagcauu

SEQ ID NO: 25694 - RNA, 20 nt, Artificial Sequence
  targeting sequence with TTCN PAM
aaugaggggacguuuccacc

SEQ ID NO: 25695 - RNA, 20 nt, Artificial Sequence
  targeting sequence with TTCN PAM
acccagaacaacuguuaagc

SEQ ID NO: 25696 - RNA, 20 nt, Artificial Sequence
  targeting sequence with TTCN PAM
ggguggaaacguccccucau

SEQ ID NO: 25697 - RNA, 20 nt, Artificial Sequence
  targeting sequence with TTCN PAM
auaaccucgcucuaauggcu

SEQ ID NO: 25698 - RNA, 20 nt, Artificial Sequence
  targeting sequence with TTCN PAM
uuugucuugucagagcucuu

SEQ ID NO: 25699 - RNA, 20 nt, Artificial Sequence
  targeting sequence with TTCN PAM
uggguucuuuugucuuguca

SEQ ID NO: 25700 - RNA, 20 nt, Artificial Sequence
  targeting sequence with TTCN PAM
uugugguuguucuuggguuc

SEQ ID NO: 25701 - RNA, 20 nt, Artificial Sequence
  targeting sequence with TTCN PAM
uucauugugguuguucuugg

SEQ ID NO: 25702 - RNA, 20 nt, Artificial Sequence
  targeting sequence with TTCN PAM
uugcuguaccuuuugcugcc

SEQ ID NO: 25703 - RNA, 20 nt, Artificial Sequence
  targeting sequence with TTCN PAM
uucuuugcuguaccuuuugc

SEQ ID NO: 25704 - RNA, 20 nt, Artificial Sequence
  targeting sequence with TTCN PAM
gggucuggugaauaauuaag

SEQ ID NO: 25705 - RNA, 20 nt, Artificial Sequence
  targeting sequence with TTCN PAM
ccagacccagaaguuguacg

SEQ ID NO: 25706 - RNA, 20 nt, Artificial Sequence
  targeting sequence with TTCN PAM
ugucccuuaauuauucacca

SEQ ID NO: 25707 - RNA, 20 nt, Artificial Sequence
  targeting sequence with TTCN PAM
gugcagaucaggugcaguaa

SEQ ID NO: 25708 - RNA, 20 nt, Artificial Sequence
  targeting sequence with TTCN PAM
uaagacaguuugagaaagga

SEQ ID NO: 25709 - RNA, 20 nt, Artificial Sequence
  targeting sequence with TTCN PAM
caaacugucuuaggaaggac

SEQ ID NO: 25710 - RNA, 20 nt, Artificial Sequence
  targeting sequence with TTCN PAM
uuucucaaacugucuuagga

SEQ ID NO: 25711 - RNA, 20 nt, Artificial Sequence
  targeting sequence with TTCN PAM
aucuuccuuucucaaacugu

SEQ ID NO: 25712 - RNA, 20 nt, Artificial Sequence
  targeting sequence with TTCN PAM
acaggugaaaaccuuccuuu

SEQ ID NO: 25713 - RNA, 20 nt, Artificial Sequence
  targeting sequence with TTCN PAM
ccuguagaaagcccccugcc

SEQ ID NO: 25714 - RNA, 20 nt, Artificial Sequence
  targeting sequence with TTCN PAM
uuugauagauagaaaccguc

SEQ ID NO: 25715 - RNA, 20 nt, Artificial Sequence
  targeting sequence with TTCN PAM
aucuaucaaaggaagguuuu

SEQ ID NO: 25716 - RNA, 20 nt, Artificial Sequence
  targeting sequence with TTCN PAM
uauuugcccugggacgguuu

SEQ ID NO: 25717 - RNA, 20 nt, Artificial Sequence
  targeting sequence with TTCN PAM
auccaucuaucaaagugacu

SEQ ID NO: 25718 - RNA, 20 nt, Artificial Sequence
  targeting sequence with TTCN PAM
agugcccacaaaacuuaagu

SEQ ID NO: 25719 - RNA, 20 nt, Artificial Sequence
  targeting sequence with TTCN PAM
ggcaguuugggggacucaaa

SEQ ID NO: 25720 - RNA, 20 nt, Artificial Sequence
  targeting sequence with TTCN PAM
agcuuagaaaaacuggugga

SEQ ID NO: 25721 - RNA, 20 nt, Artificial Sequence
  targeting sequence with TTCN PAM
aagcuagaaccuuugagucc

SEQ ID NO: 25722 - RNA, 20 nt, Artificial Sequence
  targeting sequence with TTCN PAM
gcuuuagcguaauugcucag

SEQ ID NO: 25723 - RNA, 20 nt, Artificial Sequence
  targeting sequence with TTCN PAM
ccuaacuuucugcuuuagcg

SEQ ID NO: 25724 - RNA, 20 nt, Artificial Sequence
  targeting sequence with TTCN PAM
aaaaguucauaguguccuuu

SEQ ID NO: 25725 - RNA, 20 nt, Artificial Sequence
  targeting sequence with TTCN PAM
uaguguccuuuggcacuccu

SEQ ID NO: 25726 - RNA, 20 nt, Artificial Sequence
  targeting sequence with TTCN PAM
ugccaaaaacaaauuguccc

SEQ ID NO: 25727 - RNA, 20 nt, Artificial Sequence
  targeting sequence with TTCN PAM
uguucaugccaaaaacaaau

SEQ ID NO: 25728 - RNA, 20 nt, Artificial Sequence
  targeting sequence with TTCN PAM
aauuuuuuuuuuuuuaaaga

SEQ ID NO: 25729 - RNA, 20 nt, Artificial Sequence
  targeting sequence with TTCN PAM
uuaaaaaaaaaaaaauuaga

SEQ ID NO: 25730 - RNA, 20 nt, Artificial Sequence
  targeting sequence with TTCN PAM
ccccaaccucagcugauugu

SEQ ID NO: 25731 - RNA, 20 nt, Artificial Sequence
  targeting sequence with TTCN PAM
auaacuacuuugauauuuua

SEQ ID NO: 25732 - RNA, 20 nt, Artificial Sequence
  targeting sequence with TTCN PAM
cagagccagcauguuguuuc

SEQ ID NO: 25733 - RNA, 20 nt, Artificial Sequence
  targeting sequence with TTCN PAM
gacaggcagggcaaugcuaa

SEQ ID NO: 25734 - RNA, 20 nt, Artificial Sequence
  targeting sequence with TTCN PAM
gaaggaauuuccugguaagu

SEQ ID NO: 25735 - RNA, 20 nt, Artificial Sequence
  targeting sequence with TTCN PAM
gaacuagauuagcauugccc

SEQ ID NO: 25736 - RNA, 20 nt, Artificial Sequence
  targeting sequence with TTCN PAM
uucagaacuagauuagcauu

SEQ ID NO: 25737 - RNA, 20 nt, Artificial Sequence
  targeting sequence with TTCN PAM
ugguaaguggaaacaggcaa

SEQ ID NO: 25738 - RNA, 20 nt, Artificial Sequence
  targeting sequence with TTCN PAM
acuuaccaggaaauuccuuc

SEQ ID NO: 25739 - RNA, 20 nt, Artificial Sequence
  targeting sequence with TTCN PAM
gggcaucuuauaugcacuug

SEQ ID NO: 25740 - RNA, 20 nt, Artificial Sequence
  targeting sequence with TTCN PAM
gugcaaccaagugcauauaa

SEQ ID NO: 25741 - RNA, 20 nt, Artificial Sequence
  targeting sequence with TTCN PAM
cucuuagccucauucugugc

SEQ ID NO: 25742 - RNA, 20 nt, Artificial Sequence
  targeting sequence with TTCN PAM
auauuauuuguaguauuggu

SEQ ID NO: 25743 - RNA, 20 nt, Artificial Sequence
  targeting sequence with TTCN PAM
aguuccaccaggaugaugga

SEQ ID NO: 25744 - RNA, 20 nt, Artificial Sequence
  targeting sequence with TTCN PAM
accaggaugauggaacuggu

SEQ ID NO: 25745 - RNA, 20 nt, Artificial Sequence
  targeting sequence with TTCN PAM
aucauccugguggaacuuga

SEQ ID NO: 25746 - RNA, 20 nt, Artificial Sequence
  targeting sequence with TTCN PAM
cccgucgcauaaccaguucc

SEQ ID NO: 25747 - RNA, 20 nt, Artificial Sequence
  targeting sequence with TTCN PAM
uuuuucaaaaccaucuauag

SEQ ID NO: 25748 - RNA, 20 nt, Artificial Sequence
  targeting sequence with TTCN PAM
aaaccaucuauagaagucca

SEQ ID NO: 25749 - RNA, 20 nt, Artificial Sequence
  targeting sequence with TTCN PAM
auagaugguuuugaaaaaug

SEQ ID NO: 25750 - RNA, 20 nt, Artificial Sequence
  targeting sequence with TTCN PAM
uauaauguaaacggacuugu

SEQ ID NO: 25751 - RNA, 20 nt, Artificial Sequence
  targeting sequence with TTCN PAM
cacccaaaacuuggguccug

SEQ ID NO: 25752 - RNA, 20 nt, Artificial Sequence
  targeting sequence with TTCN PAM
uucacugcucuuuaggagaa

SEQ ID NO: 25753 - RNA, 20 nt, Artificial Sequence
  targeting sequence with TTCN PAM
cugcucuuuaggagaaucac

SEQ ID NO: 25754 - RNA, 20 nt, Artificial Sequence
  targeting sequence with TTCN PAM
ccuaaagagcagugaaggaa

SEQ ID NO: 25755 - RNA, 20 nt, Artificial Sequence
  targeting sequence with TTCN PAM
cuuaggcagacagaauaaag

SEQ ID NO: 25756 - RNA, 20 nt, Artificial Sequence
  targeting sequence with TTCN PAM
gucugccuaagagaaucaac

SEQ ID NO: 25757 - RNA, 20 nt, Artificial Sequence
  targeting sequence with TTCN PAM
aagcuuuauucugucugccu

SEQ ID NO: 25758 - RNA, 20 nt, Artificial Sequence
  targeting sequence with TTCN PAM
uaauuucaaagcuuuauucu

SEQ ID NO: 25759 - RNA, 20 nt, Artificial Sequence
  targeting sequence with TTCN PAM
uuuuggccccagcauucuua

SEQ ID NO: 25760 - RNA, 20 nt, Artificial Sequence
  targeting sequence with TTCN PAM
gucuucauuuuggccccagc

SEQ ID NO: 25761 - RNA, 20 nt, Artificial Sequence
  targeting sequence with TTCN PAM
uuaauuuauuuuguuaacac

SEQ ID NO: 25762 - RNA, 20 nt, Artificial Sequence
  targeting sequence with TTCN PAM
uaaagacaaccccagcccaa

SEQ ID NO: 25763 - RNA, 20 nt, Artificial Sequence
  targeting sequence with TTCN PAM
cccagugaucuugggcuggg

SEQ ID NO: 25764 - RNA, 20 nt, Artificial Sequence
  targeting sequence with TTCN PAM
uggggcaaaaaaaaaaaaaa

SEQ ID NO: 25765 - RNA, 20 nt, Artificial Sequence
  targeting sequence with TTCN PAM
aaaaaccaguguaguaggau

SEQ ID NO: 25766 - RNA, 20 nt, Artificial Sequence
  targeting sequence with TTCN PAM
ucuucaacuaagccaaaccc

SEQ ID NO: 25767 - RNA, 20 nt, Artificial Sequence
  targeting sequence with TTCN PAM
acuaagccaaacccauaaaa

SEQ ID NO: 25768 - RNA, 20 nt, Artificial Sequence
  targeting sequence with TTCN PAM
uacucaaacuguuucaagac

SEQ ID NO: 25769 - RNA, 20 nt, Artificial Sequence
  targeting sequence with TTCN PAM
agacaagagggagcagcaca

SEQ ID NO: 25770 - RNA, 20 nt, Artificial Sequence
  targeting sequence with TTCN PAM
ucauuuaaaaacaucacuuc

SEQ ID NO: 25771 - RNA, 20 nt, Artificial Sequence
  targeting sequence with TTCN PAM
uuuaaaaacaucacuucuuu

SEQ ID NO: 25772 - RNA, 20 nt, Artificial Sequence
  targeting sequence with TTCN PAM
uuauuucaaaggaaaaauaa

SEQ ID NO: 25773 - RNA, 20 nt, Artificial Sequence
  targeting sequence with TTCN PAM
aaggaaaaauaaaagacccu

SEQ ID NO: 25774 - RNA, 20 nt, Artificial Sequence
  targeting sequence with TTCN PAM
uuugaaauaaagaagugaug

SEQ ID NO: 25775 - RNA, 20 nt, Artificial Sequence
  targeting sequence with TTCN PAM
aauaggauuuuuuauuauug

SEQ ID NO: 25776 - RNA, 20 nt, Artificial Sequence
  targeting sequence with TTCN PAM
uuaugguuucuaauaggauu

SEQ ID NO: 25777 - RNA, 20 nt, Artificial Sequence
  targeting sequence with TTCN PAM
ucaaguaugcuguucggauu

SEQ ID NO: 25778 - RNA, 20 nt, Artificial Sequence
  targeting sequence with TTCN PAM
aguaugcuguucggauuuuu

SEQ ID NO: 25779 - RNA, 20 nt, Artificial Sequence
  targeting sequence with TTCN PAM
gauuuuuuauuuuuagguug

SEQ ID NO: 25780 - RNA, 20 nt, Artificial Sequence
  targeting sequence with TTCN PAM
cuuuuguauccucgucaagg

SEQ ID NO: 25781 - RNA, 20 nt, Artificial Sequence
  targeting sequence with TTCN PAM
aaagugaucauacuuccagg

SEQ ID NO: 25782 - RNA, 20 nt, Artificial Sequence
  targeting sequence with TTCN PAM
aggauuagcguaaguggcca

SEQ ID NO: 25783 - RNA, 20 nt, Artificial Sequence
  targeting sequence with TTCN PAM
cacccaaguuggccacuuac

SEQ ID NO: 25784 - RNA, 20 nt, Artificial Sequence
  targeting sequence with TTCN PAM
uccacggacaacgaaaaucc

SEQ ID NO: 25785 - RNA, 20 nt, Artificial Sequence
  targeting sequence with TTCN PAM
acggacaacgaaaauccacc

SEQ ID NO: 25786 - RNA, 20 nt, Artificial Sequence
  targeting sequence with TTCN PAM
uuguccguggaagaacacau

SEQ ID NO: 25787 - RNA, 20 nt, Artificial Sequence
  targeting sequence with TTCN PAM
ggguggauuuucguuguccg

SEQ ID NO: 25788 - RNA, 20 nt, Artificial Sequence
  targeting sequence with TTCN PAM
gacauggaaugugguaggau

SEQ ID NO: 25789 - RNA, 20 nt, Artificial Sequence
  targeting sequence with TTCN PAM
augucugaauuuuuggauuc

SEQ ID NO: 25790 - RNA, 20 nt, Artificial Sequence
  targeting sequence with TTCN PAM
caguaaaguuagucugggau

SEQ ID NO: 25791 - RNA, 20 nt, Artificial Sequence
  targeting sequence with TTCN PAM
caucuuuuuaguggguuuua

SEQ ID NO: 25792 - RNA, 20 nt, Artificial Sequence
  targeting sequence with TTCN PAM
agccacaauuuagauugccc

SEQ ID NO: 25793 - RNA, 20 nt, Artificial Sequence
  targeting sequence with TTCN PAM
gugugcuccagauuguuggu

SEQ ID NO: 25794 - RNA, 20 nt, Artificial Sequence
  targeting sequence with TTCN PAM
uauuaaaggacuguuuuaag

SEQ ID NO: 25795 - RNA, 20 nt, Artificial Sequence
  targeting sequence with TTCN PAM
uugggaugcaaaucuuaaaa

SEQ ID NO: 25796 - RNA, 20 nt, Artificial Sequence
  targeting sequence with TTCN PAM
cccaaaaaacuucuuggaua

SEQ ID NO: 25797 - RNA, 20 nt, Artificial Sequence
  targeting sequence with TTCN PAM
uggauaaaaucuaaaaaaua

SEQ ID NO: 25798 - RNA, 20 nt, Artificial Sequence
  targeting sequence with TTCN PAM
agagacgcaauugcaauagu

SEQ ID NO: 25799 - RNA, 20 nt, Artificial Sequence
  targeting sequence with TTCN PAM
ucaagagacgcaauugcaau

SEQ ID NO: 25800 - RNA, 20 nt, Artificial Sequence
  targeting sequence with TTCN PAM
aaauguaaacagauucacuc

SEQ ID NO: 25801 - RNA, 20 nt, Artificial Sequence
  targeting sequence with TTCN PAM
cucaacucuuuuuuuguugu

SEQ ID NO: 25802 - RNA, 20 nt, Artificial Sequence
  targeting sequence with TTCN PAM
acaacaaaaaaagaguugag

SEQ ID NO: 25803 - RNA, 20 nt, Artificial Sequence
  targeting sequence with TTCN PAM
gaguagguaaguugcugucu

SEQ ID NO: 25804 - RNA, 20 nt, Artificial Sequence
  targeting sequence with TTCN PAM
cuacccucuggcgagugcau

SEQ ID NO: 25805 - RNA, 20 nt, Artificial Sequence
  targeting sequence with TTCN PAM
gugccagcaucaucuagggg

SEQ ID NO: 25806 - RNA, 20 nt, Artificial Sequence
  targeting sequence with TTCN PAM
uccccuagaugaugcuggca

SEQ ID NO: 25807 - RNA, 20 nt, Artificial Sequence
  targeting sequence with TTCN PAM
uuucauccccuagaugaugc

SEQ ID NO: 25808 - RNA, 20 nt, Artificial Sequence
  targeting sequence with TTCN PAM
acauagcugaagagggcguc

SEQ ID NO: 25809 - RNA, 20 nt, Artificial Sequence
  targeting sequence with TTCN PAM
gcuauguggaacgguucuuu

SEQ ID NO: 25810 - RNA, 20 nt, Artificial Sequence
  targeting sequence with TTCN PAM
agagaaaggcaauaaaaacc

SEQ ID NO: 25811 - RNA, 20 nt, Artificial Sequence
  targeting sequence with TTCN PAM
cuggaagcacugggacgccc

SEQ ID NO: 25812 - RNA, 20 nt, Artificial Sequence
  targeting sequence with TTCN PAM
uugugguuuuuauugccuuu

SEQ ID NO: 25813 - RNA, 20 nt, Artificial Sequence
  targeting sequence with TTCN PAM
gcacuuuauuccuugugguu

SEQ ID NO: 25814 - RNA, 20 nt, Artificial Sequence
  targeting sequence with TTCN PAM
ugagggggaccacacaguug

SEQ ID NO: 25815 - RNA, 20 nt, Artificial Sequence
  targeting sequence with TTCN PAM
gggcaaacucaucaacaucc

SEQ ID NO: 25816 - RNA, 20 nt, Artificial Sequence
  targeting sequence with TTCN PAM
gggcaguggcauucuccagc

SEQ ID NO: 25817 - RNA, 20 nt, Artificial Sequence
  targeting sequence with TTCN PAM
ccagcccuucuagcugcacc

SEQ ID NO: 25818 - RNA, 20 nt, Artificial Sequence
  targeting sequence with TTCN PAM
agcugcaccaccugcugcug

SEQ ID NO: 25819 - RNA, 20 nt, Artificial Sequence
  targeting sequence with TTCN PAM
ggcccacaggaggcccugga

SEQ ID NO: 25820 - RNA, 20 nt, Artificial Sequence
  targeting sequence with TTCN PAM
cuguucuggcccacaggagg

SEQ ID NO: 25821 - RNA, 20 nt, Artificial Sequence
  targeting sequence with TTCN PAM
gcucacaaguauucugagau

SEQ ID NO: 25822 - RNA, 20 nt, Artificial Sequence
  targeting sequence with TTCN PAM
gagaugcugacaugcccccu

SEQ ID NO: 25823 - RNA, 20 nt, Artificial Sequence
  targeting sequence with TTCN PAM
aggcuccagcauauuuauaa

SEQ ID NO: 25824 - RNA, 20 nt, Artificial Sequence
  targeting sequence with TTCN PAM
uucaaggcuccagcauauuu

SEQ ID NO: 25825 - RNA, 20 nt, Artificial Sequence
  targeting sequence with TTCN PAM
agugauuauuauucccccaa

SEQ ID NO: 25826 - RNA, 20 nt, Artificial Sequence
  targeting sequence with TTCN PAM
cccaaauugcccuccacugc

SEQ ID NO: 25827 - RNA, 20 nt, Artificial Sequence
  targeting sequence with TTCN PAM
agugggaugagucacaggaa

SEQ ID NO: 25828 - RNA, 20 nt, Artificial Sequence
  targeting sequence with TTCN PAM
ugugacucaucccacuggaa

SEQ ID NO: 25829 - RNA, 20 nt, Artificial Sequence
  targeting sequence with TTCN PAM
agacuaaauaaauguuaagu

SEQ ID NO: 25830 - RNA, 20 nt, Artificial Sequence
  targeting sequence with TTCN PAM
uugaaaauuaaucuaaguug

SEQ ID NO: 25831 - RNA, 20 nt, Artificial Sequence
  targeting sequence with TTCN PAM
augaaaaaagagcauauauu

SEQ ID NO: 25832 - RNA, 20 nt, Artificial Sequence
  targeting sequence with TTCN PAM
gugcaacuuagauuaauuuu

SEQ ID NO: 25833 - RNA, 20 nt, Artificial Sequence
  targeting sequence with TTCN PAM
acauaaaaaauuucaaauag

SEQ ID NO: 25834 - RNA, 20 nt, Artificial Sequence
  targeting sequence with TTCN PAM
aauaggauagucucucuuga

SEQ ID NO: 25835 - RNA, 20 nt, Artificial Sequence
  targeting sequence with TTCN PAM
uucaauuccaaucccugucc

SEQ ID NO: 25836 - RNA, 20 nt, Artificial Sequence
  targeting sequence with TTCN PAM
auuccaaucccugucccuga

SEQ ID NO: 25837 - RNA, 20 nt, Artificial Sequence
  targeting sequence with TTCN PAM
aaucccugucccugaggcag

SEQ ID NO: 25838 - RNA, 20 nt, Artificial Sequence
  targeting sequence with TTCN PAM
cccuuuuauguguguaagug

SEQ ID NO: 25839 - RNA, 20 nt, Artificial Sequence
  targeting sequence with TTCN PAM
uugacacauauaugcauaca

SEQ ID NO: 25840 - RNA, 20 nt, Artificial Sequence
  targeting sequence with TTCN PAM
guauauuuuccuugacacau

SEQ ID NO: 25841 - RNA, 20 nt, Artificial Sequence
  targeting sequence with TTCN PAM
uaucuguaaacuaaaaauaa

SEQ ID NO: 25842 - RNA, 20 nt, Artificial Sequence
  targeting sequence with TTCN PAM
uuuggcugggggucuuagga

SEQ ID NO: 25843 - RNA, 20 nt, Artificial Sequence
  targeting sequence with TTCN PAM
uugggguccacuuuggccaa

SEQ ID NO: 25844 - RNA, 20 nt, Artificial Sequence
  targeting sequence with TTCN PAM
gguuucuuugggguccacuu

SEQ ID NO: 25845 - RNA, 20 nt, Artificial Sequence
  targeting sequence with TTCN PAM
uggcaaugaugggaaagagg

SEQ ID NO: 25846 - RNA, 20 nt, Artificial Sequence
  targeting sequence with TTCN PAM
caucauugccaagaacucac

SEQ ID NO: 25847 - RNA, 20 nt, Artificial Sequence
  targeting sequence with TTCN PAM
cauuaaugcuggucauuugu

SEQ ID NO: 25848 - RNA, 20 nt, Artificial Sequence
  targeting sequence with TTCN PAM
gucagucuuaugaucucuau

SEQ ID NO: 25849 - RNA, 20 nt, Artificial Sequence
  targeting sequence with TTCN PAM
uuccaaccugacucagguau

SEQ ID NO: 25850 - RNA, 20 nt, Artificial Sequence
  targeting sequence with TTCN PAM
aaccugacucagguauagca

SEQ ID NO: 25851 - RNA, 20 nt, Artificial Sequence
  targeting sequence with TTCN PAM
agucuuuacacaaagcuuaa

SEQ ID NO: 25852 - RNA, 20 nt, Artificial Sequence
  targeting sequence with TTCN PAM
accgacugccagcuaaaaaa

SEQ ID NO: 25853 - RNA, 20 nt, Artificial Sequence
  targeting sequence with TTCN PAM
uaaagcccacuaugacuugu

SEQ ID NO: 25854 - RNA, 20 nt, Artificial Sequence
  targeting sequence with TTCN PAM
auguguugauuuaggauuuu

SEQ ID NO: 25855 - RNA, 20 nt, Artificial Sequence
  targeting sequence with TTCN PAM
ugucucccugaaauguauaa

SEQ ID NO: 25856 - RNA, 20 nt, Artificial Sequence
  targeting sequence with TTCN PAM
gggagacaggaauuguaggu

SEQ ID NO: 25857 - RNA, 20 nt, Artificial Sequence
  targeting sequence with TTCN PAM
ggcauauuuucucaggaccu

SEQ ID NO: 25858 - RNA, 20 nt, Artificial Sequence
  targeting sequence with TTCN PAM
caggaccucuucagacugug

SEQ ID NO: 25859 - RNA, 20 nt, Artificial Sequence
  targeting sequence with TTCN PAM
gacuguguuccccaggccau

SEQ ID NO: 25860 - RNA, 20 nt, Artificial Sequence
  targeting sequence with TTCN PAM
ccaggccaugguuacuugua

SEQ ID NO: 25861 - RNA, 20 nt, Artificial Sequence
  targeting sequence with TTCN PAM
gagccaauacaaguaaccau

SEQ ID NO: 25862 - RNA, 20 nt, Artificial Sequence
  targeting sequence with TTCN PAM
aaacauggaauaguaucaca

SEQ ID NO: 25863 - RNA, 20 nt, Artificial Sequence
  targeting sequence with TTCN PAM
auguuuggaaaagccaaacc

SEQ ID NO: 25864 - RNA, 20 nt, Artificial Sequence
  targeting sequence with TTCN PAM
uauagugugauacuauucca

SEQ ID NO: 25865 - RNA, 20 nt, Artificial Sequence
  targeting sequence with TTCN PAM
caacuugcuuuuuuuuucau

SEQ ID NO: 25866 - RNA, 20 nt, Artificial Sequence
  targeting sequence with TTCN PAM
uucaacagugggucuuggug

SEQ ID NO: 25867 - RNA, 20 nt, Artificial Sequence
  targeting sequence with TTCN PAM
acagugggucuuggugaucu

SEQ ID NO: 25868 - RNA, 20 nt, Artificial Sequence
  targeting sequence with TTCN PAM
guguauugacauggagagau

SEQ ID NO: 25869 - RNA, 20 nt, Artificial Sequence
  targeting sequence with TTCN PAM
cccuuggggauuuuuagguu

SEQ ID NO: 25870 - RNA, 20 nt, Artificial Sequence
  targeting sequence with TTCN PAM
acuuuuccacuauaacaaug

SEQ ID NO: 25871 - RNA, 20 nt, Artificial Sequence
  targeting sequence with TTCN PAM
acuauaacaaugaugcagug

SEQ ID NO: 25872 - RNA, 20 nt, Artificial Sequence
  targeting sequence with TTCN PAM
cugcaucauuguuauagugg

SEQ ID NO: 25873 - RNA, 20 nt, Artificial Sequence
  targeting sequence with TTCN PAM
uugaacaugcuuccuuauac

SEQ ID NO: 25874 - RNA, 20 nt, Artificial Sequence
  targeting sequence with TTCN PAM
aagaauguucacugcaucau

SEQ ID NO: 25875 - RNA, 20 nt, Artificial Sequence
  targeting sequence with TTCN PAM
uuauacacacuaccuggugu

SEQ ID NO: 25876 - RNA, 20 nt, Artificial Sequence
  targeting sequence with TTCN PAM
aagucaagucaaucccugac

SEQ ID NO: 25877 - RNA, 20 nt, Artificial Sequence
  targeting sequence with TTCN PAM
acugaugucagggauugacu

SEQ ID NO: 25878 - RNA, 20 nt, Artificial Sequence
  targeting sequence with TTCN PAM
uaagaagggcacacucuccu

SEQ ID NO: 25879 - RNA, 20 nt, Artificial Sequence
  targeting sequence with TTCN PAM
uaagaaggcagaucagagau

SEQ ID NO: 25880 - RNA, 20 nt, Artificial Sequence
  targeting sequence with TTCN PAM
ugcuauuuuuuugagacgga

SEQ ID NO: 25881 - RNA, 20 nt, Artificial Sequence
  targeting sequence with TTCN PAM
ggccauucuucugccucagc

SEQ ID NO: 25882 - RNA, 20 nt, Artificial Sequence
  targeting sequence with TTCN PAM
ucugccucagccuccugagu

SEQ ID NO: 25883 - RNA, 20 nt, Artificial Sequence
  targeting sequence with TTCN PAM
gccucagccuccugaguagc

SEQ ID NO: 25884 - RNA, 20 nt, Artificial Sequence
  targeting sequence with TTCN PAM
ccguguuaggauggucuuga

SEQ ID NO: 25885 - RNA, 20 nt, Artificial Sequence
  targeting sequence with TTCN PAM
ugcuauuuuuuaacuuuaua

SEQ ID NO: 25886 - RNA, 20 nt, Artificial Sequence
  targeting sequence with TTCN PAM
guaucgcucaauuacuaaaa

SEQ ID NO: 25887 - RNA, 20 nt, Artificial Sequence
  targeting sequence with TTCN PAM
aguuuuuuuaguaauugagc

SEQ ID NO: 25888 - RNA, 20 nt, Artificial Sequence
  targeting sequence with TTCN PAM
uuaauguauuaguauuuuac

SEQ ID NO: 25889 - RNA, 20 nt, Artificial Sequence
  targeting sequence with TTCN PAM
aaacauuagacucauuaaug

SEQ ID NO: 25890 - RNA, 20 nt, Artificial Sequence
  targeting sequence with TTCN PAM
aauugcauauguuauaagac

SEQ ID NO: 25891 - RNA, 20 nt, Artificial Sequence
  targeting sequence with TTCN PAM
auuuaacauacgccuaauuc

SEQ ID NO: 25892 - RNA, 20 nt, Artificial Sequence
  targeting sequence with TTCN PAM
cacaccuccccccaaccccc

SEQ ID NO: 25893 - RNA, 20 nt, Artificial Sequence
  targeting sequence with TTCN PAM
ccucaaggucauagccuuca

SEQ ID NO: 25894 - RNA, 20 nt, Artificial Sequence
  targeting sequence with TTCN PAM
cucaugaguuuaaauuaauu

SEQ ID NO: 25895 - RNA, 20 nt, Artificial Sequence
  targeting sequence with TTCN PAM
aaaguauucaagggauagaa

SEQ ID NO: 25896 - RNA, 20 nt, Artificial Sequence
  targeting sequence with TTCN PAM
agggauagaaccuauuuccc

SEQ ID NO: 25897 - RNA, 20 nt, Artificial Sequence
  targeting sequence with TTCN PAM
aucccuugaauacuuuggaa

SEQ ID NO: 25898 - RNA, 20 nt, Artificial Sequence
  targeting sequence with TTCN PAM
cuagcuauggucagauaucc

SEQ ID NO: 25899 - RNA, 20 nt, Artificial Sequence
  targeting sequence with TTCN PAM
gguccugguuuccugggauu

SEQ ID NO: 25900 - RNA, 20 nt, Artificial Sequence
  targeting sequence with TTCN PAM
ugggauuugagguaaggcuu

SEQ ID NO: 25901 - RNA, 20 nt, Artificial Sequence
  targeting sequence with TTCN PAM
gacugacgccaacuauagac

SEQ ID NO: 25902 - RNA, 20 nt, Artificial Sequence
  targeting sequence with TTCN PAM
ggacuggacagcauccauug

SEQ ID NO: 25903 - RNA, 20 nt, Artificial Sequence
  targeting sequence with TTCN PAM
uaagauccuucuggacugga

SEQ ID NO: 25904 - RNA, 20 nt, Artificial Sequence
  targeting sequence with TTCN PAM
ggcccugcuuauguuuuaau

SEQ ID NO: 25905 - RNA, 20 nt, Artificial Sequence
  targeting sequence with TTCN PAM
ucaggcccugcuuauguuuu

SEQ ID NO: 25906 - RNA, 20 nt, Artificial Sequence
  targeting sequence with TTCN PAM
cuugauucuuuuaggcuguu

SEQ ID NO: 25907 - RNA, 20 nt, Artificial Sequence
  targeting sequence with TTCN PAM
uuuaggcuguuguaauacaa

SEQ ID NO: 25908 - RNA, 20 nt, Artificial Sequence
  targeting sequence with TTCN PAM
ggcccacuucccuucucuga

SEQ ID NO: 25909 - RNA, 20 nt, Artificial Sequence
  targeting sequence with TTCN PAM
cuucucugagacuagugucu

SEQ ID NO: 25910 - RNA, 20 nt, Artificial Sequence
  targeting sequence with TTCN PAM
cugagacuagugucuuucaa

SEQ ID NO: 25911 - RNA, 20 nt, Artificial Sequence
  targeting sequence with TTCN PAM
aaaugcuuucauaugaaacc

SEQ ID NO: 25912 - RNA, 20 nt, Artificial Sequence
  targeting sequence with TTCN PAM
uaugaaaccacuaagaacua

SEQ ID NO: 25913 - RNA, 20 nt, Artificial Sequence
  targeting sequence with TTCN PAM
uaugaaagcauuuugaaaga

SEQ ID NO: 25914 - RNA, 20 nt, Artificial Sequence
  targeting sequence with TTCN PAM
uagugguuucauaugaaagc

SEQ ID NO: 25915 - RNA, 20 nt, Artificial Sequence
  targeting sequence with TTCN PAM
cuaaauaccuccauauagaa

SEQ ID NO: 25916 - RNA, 20 nt, Artificial Sequence
  targeting sequence with TTCN PAM
auauggagguauuuagggaa

SEQ ID NO: 25917 - RNA, 20 nt, Artificial Sequence
  targeting sequence with TTCN PAM
uauuucuauauggagguauu

SEQ ID NO: 25918 - RNA, 20 nt, Artificial Sequence
  targeting sequence with TTCN PAM
acuuccucacagaauaaaau

SEQ ID NO: 25919 - RNA, 20 nt, Artificial Sequence
  targeting sequence with TTCN PAM
ucacagaauaaaauagaugg

SEQ ID NO: 25920 - RNA, 20 nt, Artificial Sequence
  targeting sequence with TTCN PAM
gugaggaaguagaauauuua

SEQ ID NO: 25921 - RNA, 20 nt, Artificial Sequence
  targeting sequence with TTCN PAM
ugcaaacugucaggcaaugu

SEQ ID NO: 25922 - RNA, 20 nt, Artificial Sequence
  targeting sequence with TTCN PAM
agcugccaaauccaaaucuc

SEQ ID NO: 25923 - RNA, 20 nt, Artificial Sequence
  targeting sequence with TTCN PAM
cacagaaggagaagacaagg

SEQ ID NO: 25924 - RNA, 20 nt, Artificial Sequence
  targeting sequence with TTCN PAM
gugggaaagggggcuuuuau

SEQ ID NO: 25925 - RNA, 20 nt, Artificial Sequence
  targeting sequence with TTCN PAM
ccuucugugggaaagggggc

SEQ ID NO: 25926 - RNA, 20 nt, Artificial Sequence
  targeting sequence with TTCN PAM
aaagcagcucugacaaguau

SEQ ID NO: 25927 - RNA, 20 nt, Artificial Sequence
  targeting sequence with TTCN PAM
ugugguuuuccauacacuga

SEQ ID NO: 25928 - RNA, 20 nt, Artificial Sequence
  targeting sequence with TTCN PAM
auacacugagauuacuguga

SEQ ID NO: 25929 - RNA, 20 nt, Artificial Sequence
  targeting sequence with TTCN PAM
uaggaucacaguaaucucag

SEQ ID NO: 25930 - RNA, 20 nt, Artificial Sequence
  targeting sequence with TTCN PAM
caaguaccaagcagacauac

SEQ ID NO: 25931 - RNA, 20 nt, Artificial Sequence
  targeting sequence with TTCN PAM
caaaaguuuauaccauuuug

SEQ ID NO: 25932 - RNA, 20 nt, Artificial Sequence
  targeting sequence with TTCN PAM
uuguucucuaccuucucauc

SEQ ID NO: 25933 - RNA, 20 nt, Artificial Sequence
  targeting sequence with TTCN PAM
cuaccuucucaucuuuuuuc

SEQ ID NO: 25934 - RNA, 20 nt, Artificial Sequence
  targeting sequence with TTCN PAM
caucuuuuuuccuuccgcug

SEQ ID NO: 25935 - RNA, 20 nt, Artificial Sequence
  targeting sequence with TTCN PAM
uuccgcuguuuuccuuuuuu

SEQ ID NO: 25936 - RNA, 20 nt, Artificial Sequence
  targeting sequence with TTCN PAM
gcuguuuuccuuuuuucuuu

SEQ ID NO: 25937 - RNA, 20 nt, Artificial Sequence
  targeting sequence with TTCN PAM
uuuuuucuuucuaacccuac

SEQ ID NO: 25938 - RNA, 20 nt, Artificial Sequence
  targeting sequence with TTCN PAM
uucuaacccuacuguauuuu

SEQ ID NO: 25939 - RNA, 20 nt, Artificial Sequence
  targeting sequence with TTCN PAM
aacccuacuguauuuugcau

SEQ ID NO: 25940 - RNA, 20 nt, Artificial Sequence
  targeting sequence with TTCN PAM
uucauacuaaccuggauguc

SEQ ID NO: 25941 - RNA, 20 nt, Artificial Sequence
  targeting sequence with TTCN PAM
uacuaaccuggaugucccgg

SEQ ID NO: 25942 - RNA, 20 nt, Artificial Sequence
  targeting sequence with TTCN PAM
uaggacugauacgcgauuuu

SEQ ID NO: 25943 - RNA, 20 nt, Artificial Sequence
  targeting sequence with TTCN PAM
uccaugcuugccaguuccug

SEQ ID NO: 25944 - RNA, 20 nt, Artificial Sequence
  targeting sequence with TTCN PAM
augcuugccaguuccugcuu

SEQ ID NO: 25945 - RNA, 20 nt, Artificial Sequence
  targeting sequence with TTCN PAM
ugcuucaaguucaagauuuc

SEQ ID NO: 25946 - RNA, 20 nt, Artificial Sequence
  targeting sequence with TTCN PAM
aguucaagauuucauucugg

SEQ ID NO: 25947 - RNA, 20 nt, Artificial Sequence
  targeting sequence with TTCN PAM
agauuucauucugguggagc

SEQ ID NO: 25948 - RNA, 20 nt, Artificial Sequence
  targeting sequence with TTCN PAM
uucugguggagcucuguuag

SEQ ID NO: 25949 - RNA, 20 nt, Artificial Sequence
  targeting sequence with TTCN PAM
gguggagcucuguuagguca

SEQ ID NO: 25950 - RNA, 20 nt, Artificial Sequence
  targeting sequence with TTCN PAM
uccaaucguucacaucuaag

SEQ ID NO: 25951 - RNA, 20 nt, Artificial Sequence
  targeting sequence with TTCN PAM
aaucguucacaucuaaggag

SEQ ID NO: 25952 - RNA, 20 nt, Artificial Sequence
  targeting sequence with TTCN PAM
caucuaaggagaaaaaaaaa

SEQ ID NO: 25953 - RNA, 20 nt, Artificial Sequence
  targeting sequence with TTCN PAM
ccuuagaugugaacgauugg

SEQ ID NO: 25954 - RNA, 20 nt, Artificial Sequence
  targeting sequence with TTCN PAM
aaacuuuuuuuuucuccuua

SEQ ID NO: 25955 - RNA, 20 nt, Artificial Sequence
  targeting sequence with TTCN PAM
uaaaauucuaaacuuuuuuu

SEQ ID NO: 25956 - RNA, 20 nt, Artificial Sequence
  targeting sequence with TTCN PAM
gugaauaucuuuccuggcau

SEQ ID NO: 25957 - RNA, 20 nt, Artificial Sequence
  targeting sequence with TTCN PAM
cagaauucauaaaauucuaa

SEQ ID NO: 25958 - RNA, 20 nt, Artificial Sequence
  targeting sequence with TTCN PAM
uggcauuauuuacauccaac

SEQ ID NO: 25959 - RNA, 20 nt, Artificial Sequence
  targeting sequence with TTCN PAM
acaaaggaauagaagcacaa

SEQ ID NO: 25960 - RNA, 20 nt, Artificial Sequence
  targeting sequence with TTCN PAM
uuuguagaauguguuuuggg

SEQ ID NO: 25961 - RNA, 20 nt, Artificial Sequence
  targeting sequence with TTCN PAM
auuccuuuguagaauguguu

SEQ ID NO: 25962 - RNA, 20 nt, Artificial Sequence
  targeting sequence with TTCN PAM
uugugcuucuauuccuuugu

SEQ ID NO: 25963 - RNA, 20 nt, Artificial Sequence
  targeting sequence with TTCN PAM
agagacuaagagcuauaccc

SEQ ID NO: 25964 - RNA, 20 nt, Artificial Sequence
  targeting sequence with TTCN PAM
auaaucuuuucaauacacag

SEQ ID NO: 25965 - RNA, 20 nt, Artificial Sequence
  targeting sequence with TTCN PAM
auacacaguauuugcagcga

SEQ ID NO: 25966 - RNA, 20 nt, Artificial Sequence
  targeting sequence with TTCN PAM
gaggagccuaaugacugucu

SEQ ID NO: 25967 - RNA, 20 nt, Artificial Sequence
  targeting sequence with TTCN PAM
ugaggcuugcuuaauuguac

SEQ ID NO: 25968 - RNA, 20 nt, Artificial Sequence
  targeting sequence with TTCN PAM
auugguguguuaucuuuuca

SEQ ID NO: 25969 - RNA, 20 nt, Artificial Sequence
  targeting sequence with TTCN PAM
ggcagucaccaguagcuuau

SEQ ID NO: 25970 - RNA, 20 nt, Artificial Sequence
  targeting sequence with TTCN PAM
agaacuggccagcucacuca

SEQ ID NO: 25971 - RNA, 20 nt, Artificial Sequence
  targeting sequence with TTCN PAM
ggaauaagcuacuggugacu

SEQ ID NO: 25972 - RNA, 20 nt, Artificial Sequence
  targeting sequence with TTCN PAM
gagcccuagaaugccagagc

SEQ ID NO: 25973 - RNA, 20 nt, Artificial Sequence
  targeting sequence with TTCN PAM
agggcucugaaucgcaaaca

SEQ ID NO: 25974 - RNA, 20 nt, Artificial Sequence
  targeting sequence with TTCN PAM
gucaacaaauauuuacugag

SEQ ID NO: 25975 - RNA, 20 nt, Artificial Sequence
  targeting sequence with TTCN PAM
aaguacugggaauauugugg

SEQ ID NO: 25976 - RNA, 20 nt, Artificial Sequence
  targeting sequence with TTCN PAM
caguacuuugaacaugccug

SEQ ID NO: 25977 - RNA, 20 nt, Artificial Sequence
  targeting sequence with TTCN PAM
cauauggagaaguaaaacaa

SEQ ID NO: 25978 - RNA, 20 nt, Artificial Sequence
  targeting sequence with TTCN PAM
ccauaugggaaaucaucuug

SEQ ID NO: 25979 - RNA, 20 nt, Artificial Sequence
  targeting sequence with TTCN PAM
uuguuuuacuucuccauaug

SEQ ID NO: 25980 - RNA, 20 nt, Artificial Sequence
  targeting sequence with TTCN PAM
aggcugggcaugguggcuca

SEQ ID NO: 25981 - RNA, 20 nt, Artificial Sequence
  targeting sequence with TTCN PAM
agguggaaaaaugaauguga

SEQ ID NO: 25982 - RNA, 20 nt, Artificial Sequence
  targeting sequence with TTCN PAM
accuagaaucucugaucuca

SEQ ID NO: 25983 - RNA, 20 nt, Artificial Sequence
  targeting sequence with TTCN PAM
uuuuuccaccuagaaucucu

SEQ ID NO: 25984 - RNA, 20 nt, Artificial Sequence
  targeting sequence with TTCN PAM
cuccagcccuuuacucacau

SEQ ID NO: 25985 - RNA, 20 nt, Artificial Sequence
  targeting sequence with TTCN PAM
guacauuuaucauccauuuc

SEQ ID NO: 25986 - RNA, 20 nt, Artificial Sequence
  targeting sequence with TTCN PAM
aguuauucuguacauuuauc

SEQ ID NO: 25987 - RNA, 20 nt, Artificial Sequence
  targeting sequence with TTCN PAM
uccaacauagaugcacuauu

SEQ ID NO: 25988 - RNA, 20 nt, Artificial Sequence
  targeting sequence with TTCN PAM
cauuuuuuccuccaacauag

SEQ ID NO: 25989 - RNA, 20 nt, Artificial Sequence
  targeting sequence with TTCN PAM
agauuucccauuuuuuccuc

SEQ ID NO: 25990 - RNA, 20 nt, Artificial Sequence
  targeting sequence with TTCN PAM
gaucuuccagauuucccauu

SEQ ID NO: 25991 - RNA, 20 nt, Artificial Sequence
  targeting sequence with TTCN PAM
agaauugauauuaaaugagc

SEQ ID NO: 25992 - RNA, 20 nt, Artificial Sequence
  targeting sequence with TTCN PAM
agaaucccaacucuucggau

SEQ ID NO: 25993 - RNA, 20 nt, Artificial Sequence
  targeting sequence with TTCN PAM
uugggcucauuuaauaucaa

SEQ ID NO: 25994 - RNA, 20 nt, Artificial Sequence
  targeting sequence with TTCN PAM
ucaugugacuccucugcuca

SEQ ID NO: 25995 - RNA, 20 nt, Artificial Sequence
  targeting sequence with TTCN PAM
uaaaaacacauauucaucau

SEQ ID NO: 25996 - RNA, 20 nt, Artificial Sequence
  targeting sequence with TTCN PAM
cauaguggugaagaagaccg

SEQ ID NO: 25997 - RNA, 20 nt, Artificial Sequence
  targeting sequence with TTCN PAM
ccacuaugagaagacucguu

SEQ ID NO: 25998 - RNA, 20 nt, Artificial Sequence
  targeting sequence with TTCN PAM
ucaccacuaugagaagacuc

SEQ ID NO: 25999 - RNA, 20 nt, Artificial Sequence
  targeting sequence with TTCN PAM
ugggacuccacauacaaccu

SEQ ID NO: 26000 - RNA, 20 nt, Artificial Sequence
  targeting sequence with TTCN PAM
ccuaucuacuuagcucuuua

SEQ ID NO: 26001 - RNA, 20 nt, Artificial Sequence
  targeting sequence with TTCN PAM
accuuucuccuaucuacuua

SEQ ID NO: 26002 - RNA, 20 nt, Artificial Sequence
  targeting sequence with TTCN PAM
aguguuuuuuaaauguggag

SEQ ID NO: 26003 - RNA, 20 nt, Artificial Sequence
  targeting sequence with TTCN PAM
cuuuucuaguguuuuuuaaa

SEQ ID NO: 26004 - RNA, 20 nt, Artificial Sequence
  targeting sequence with TTCN PAM
ucccuuuucuaguguuuuuu

SEQ ID NO: 26005 - RNA, 20 nt, Artificial Sequence
  targeting sequence with TTCN PAM
ggugccuagaauggaaaccu

SEQ ID NO: 26006 - RNA, 20 nt, Artificial Sequence
  targeting sequence with TTCN PAM
aggcaccagaagcuagacau

SEQ ID NO: 26007 - RNA, 20 nt, Artificial Sequence
  targeting sequence with TTCN PAM
auucuaggcaccagaagcua

SEQ ID NO: 26008 - RNA, 20 nt, Artificial Sequence
  targeting sequence with TTCN PAM
cuguugggaugagagcuacc

SEQ ID NO: 26009 - RNA, 20 nt, Artificial Sequence
  targeting sequence with TTCN PAM
uacuaaaagaauaaaaaugc

SEQ ID NO: 26010 - RNA, 20 nt, Artificial Sequence
  targeting sequence with TTCN PAM
uuuaguaugaagucccuuga

SEQ ID NO: 26011 - RNA, 20 nt, Artificial Sequence
  targeting sequence with TTCN PAM
ggcauuuuuauucuuuuagu

SEQ ID NO: 26012 - RNA, 20 nt, Artificial Sequence
  targeting sequence with TTCN PAM
uucuucuuuuuaaucacauc

SEQ ID NO: 26013 - RNA, 20 nt, Artificial Sequence
  targeting sequence with TTCN PAM
ucuuuuuaaucacaucuaua

SEQ ID NO: 26014 - RNA, 20 nt, Artificial Sequence
  targeting sequence with TTCN PAM
uuuuaaucacaucuauaaua

SEQ ID NO: 26015 - RNA, 20 nt, Artificial Sequence
  targeting sequence with TTCN PAM
uuaaaaguuuguuuacauau

SEQ ID NO: 26016 - RNA, 20 nt, Artificial Sequence
  targeting sequence with TTCN PAM
uuauauucuuuaaaaguuug

SEQ ID NO: 26017 - RNA, 20 nt, Artificial Sequence
  targeting sequence with TTCN PAM
guguuuaagguaauuuuuau

SEQ ID NO: 26018 - RNA, 20 nt, Artificial Sequence
  targeting sequence with TTCN PAM
cccuuccaauaauuaugcaa

SEQ ID NO: 26019 - RNA, 20 nt, Artificial Sequence
  targeting sequence with TTCN PAM
aauaauuaugcaauaaauaa

SEQ ID NO: 26020 - RNA, 20 nt, Artificial Sequence
  targeting sequence with TTCN PAM
aagaaacaaggauuuuuuua

SEQ ID NO: 26021 - RNA, 20 nt, Artificial Sequence
  targeting sequence with TTCN PAM
uagaaaagcaguggaguuua

SEQ ID NO: 26022 - RNA, 20 nt, Artificial Sequence
  targeting sequence with TTCN PAM
ucuuuauccuugauaggagu

SEQ ID NO: 26023 - RNA, 20 nt, Artificial Sequence
  targeting sequence with TTCN PAM
uuauccuugauaggagucuc

SEQ ID NO: 26024 - RNA, 20 nt, Artificial Sequence
  targeting sequence with TTCN PAM
uuuaugcugaaacucuuccu

SEQ ID NO: 26025 - RNA, 20 nt, Artificial Sequence
  targeting sequence with TTCN PAM
gcauaaaagaaggcaguaua

SEQ ID NO: 26026 - RNA, 20 nt, Artificial Sequence
  targeting sequence with TTCN PAM
uguuauugaagugacugaac

SEQ ID NO: 26027 - RNA, 20 nt, Artificial Sequence
  targeting sequence with TTCN PAM
auaacaggaagaguuucagc

SEQ ID NO: 26028 - RNA, 20 nt, Artificial Sequence
  targeting sequence with TTCN PAM
gucacuucaauaacaggaag

SEQ ID NO: 26029 - RNA, 20 nt, Artificial Sequence
  targeting sequence with TTCN PAM
cauuagccuguucagucacu

SEQ ID NO: 26030 - RNA, 20 nt, Artificial Sequence
  targeting sequence with TTCN PAM
cugugacucugccuuuuccu

SEQ ID NO: 26031 - RNA, 20 nt, Artificial Sequence
  targeting sequence with TTCN PAM
uuucaucugcugcccagagu

SEQ ID NO: 26032 - RNA, 20 nt, Artificial Sequence
  targeting sequence with TTCN PAM
ucugcugcccagaguacgug

SEQ ID NO: 26033 - RNA, 20 nt, Artificial Sequence
  targeting sequence with TTCN PAM
ugaucacguacucugggcag

SEQ ID NO: 26034 - RNA, 20 nt, Artificial Sequence
  targeting sequence with TTCN PAM
agggaugggaccuguuccug

SEQ ID NO: 26035 - RNA, 20 nt, Artificial Sequence
  targeting sequence with TTCN PAM
accaaaauuuaaguucacaa

SEQ ID NO: 26036 - RNA, 20 nt, Artificial Sequence
  targeting sequence with TTCN PAM
caaaaugccauaagauaaug

SEQ ID NO: 26037 - RNA, 20 nt, Artificial Sequence
  targeting sequence with TTCN PAM
ugacuguccuauguuagccc

SEQ ID NO: 26038 - RNA, 20 nt, Artificial Sequence
  targeting sequence with TTCN PAM
gugguguuuucgguguuuga

SEQ ID NO: 26039 - RNA, 20 nt, Artificial Sequence
  targeting sequence with TTCN PAM
guguuugauaguuucaucau

SEQ ID NO: 26040 - RNA, 20 nt, Artificial Sequence
  targeting sequence with TTCN PAM
ucauucucucucuuuaccag

SEQ ID NO: 26041 - RNA, 20 nt, Artificial Sequence
  targeting sequence with TTCN PAM
cucucuuuaccagagagggg

SEQ ID NO: 26042 - RNA, 20 nt, Artificial Sequence
  targeting sequence with TTCN PAM
aaagugcuggucucuuggga

SEQ ID NO: 26043 - RNA, 20 nt, Artificial Sequence
  targeting sequence with TTCN PAM
cuuaaaucccaagagaccag

SEQ ID NO: 26044 - RNA, 20 nt, Artificial Sequence
  targeting sequence with TTCN PAM
ugccagauauaaccuuuccc

SEQ ID NO: 26045 - RNA, 20 nt, Artificial Sequence
  targeting sequence with TTCN PAM
ggcuucuuaggaaucuuauu

SEQ ID NO: 26046 - RNA, 20 nt, Artificial Sequence
  targeting sequence with TTCN PAM
uaggaaucuuauuugauauu

SEQ ID NO: 26047 - RNA, 20 nt, Artificial Sequence
  targeting sequence with TTCN PAM
uaagaagccugaaauuugua

SEQ ID NO: 26048 - RNA, 20 nt, Artificial Sequence
  targeting sequence with TTCN PAM
acugguauguaugagccaug

SEQ ID NO: 26049 - RNA, 20 nt, Artificial Sequence
  targeting sequence with TTCN PAM
uuucaacaaccccaagaggg

SEQ ID NO: 26050 - RNA, 20 nt, Artificial Sequence
  targeting sequence with TTCN PAM
acaaccccaagaggguagaa

SEQ ID NO: 26051 - RNA, 20 nt, Artificial Sequence
  targeting sequence with TTCN PAM
acccucuugggguuguugaa

SEQ ID NO: 26052 - RNA, 20 nt, Artificial Sequence
  targeting sequence with TTCN PAM
ucaucuauaaaaugcagaua

SEQ ID NO: 26053 - RNA, 20 nt, Artificial Sequence
  targeting sequence with TTCN PAM
guuuccucaucuauaaaaug

SEQ ID NO: 26054 - RNA, 20 nt, Artificial Sequence
  targeting sequence with TTCN PAM
cugagcuucuguuuccucau

SEQ ID NO: 26055 - RNA, 20 nt, Artificial Sequence
  targeting sequence with TTCN PAM
aaagugaauugcccaagggc

SEQ ID NO: 26056 - RNA, 20 nt, Artificial Sequence
  targeting sequence with TTCN PAM
cuuuagaacuucucugagcu

SEQ ID NO: 26057 - RNA, 20 nt, Artificial Sequence
  targeting sequence with TTCN PAM
aauccuugcugcccuacuua

SEQ ID NO: 26058 - RNA, 20 nt, Artificial Sequence
  targeting sequence with TTCN PAM
uaaacuuuacaaugugaugc

SEQ ID NO: 26059 - RNA, 20 nt, Artificial Sequence
  targeting sequence with TTCN PAM
aaauggcaucacauuguaaa

SEQ ID NO: 26060 - RNA, 20 nt, Artificial Sequence
  targeting sequence with TTCN PAM
uacuuaugaggagaguuagu

SEQ ID NO: 26061 - RNA, 20 nt, Artificial Sequence
  targeting sequence with TTCN PAM
agcucacuuuugcuaaguga

SEQ ID NO: 26062 - RNA, 20 nt, Artificial Sequence
  targeting sequence with TTCN PAM
cccaucaacuccacuuugac

SEQ ID NO: 26063 - RNA, 20 nt, Artificial Sequence
  targeting sequence with TTCN PAM
uaauuuuuuauuauacuccu

SEQ ID NO: 26064 - RNA, 20 nt, Artificial Sequence
  targeting sequence with TTCN PAM
ccaugcccucaccaacucuu

SEQ ID NO: 26065 - RNA, 20 nt, Artificial Sequence
  targeting sequence with TTCN PAM
caacagcaguauaugagggu

SEQ ID NO: 26066 - RNA, 20 nt, Artificial Sequence
  targeting sequence with TTCN PAM
auucccaacagcaguauaug

SEQ ID NO: 26067 - RNA, 20 nt, Artificial Sequence
  targeting sequence with TTCN PAM
accccagauauaacugaaaa

SEQ ID NO: 26068 - RNA, 20 nt, Artificial Sequence
  targeting sequence with TTCN PAM
guuauaucugggguagaauu

SEQ ID NO: 26069 - RNA, 20 nt, Artificial Sequence
  targeting sequence with TTCN PAM
uuucaguuauaucuggggua

SEQ ID NO: 26070 - RNA, 20 nt, Artificial Sequence
  targeting sequence with TTCN PAM
uuucuuuucaguuauaucug

SEQ ID NO: 26071 - RNA, 20 nt, Artificial Sequence
  targeting sequence with TTCN PAM
ucuauacaaaagcuuguaca

SEQ ID NO: 26072 - RNA, 20 nt, Artificial Sequence
  targeting sequence with TTCN PAM
auacaaaagcuuguacauga

SEQ ID NO: 26073 - RNA, 20 nt, Artificial Sequence
  targeting sequence with TTCN PAM
uguacaagcuuuuguauaga

SEQ ID NO: 26074 - RNA, 20 nt, Artificial Sequence
  targeting sequence with TTCN PAM
caccagcauuaaucaucauu

SEQ ID NO: 26075 - RNA, 20 nt, Artificial Sequence
  targeting sequence with TTCN PAM
cuguacaacaauauaucauc

SEQ ID NO: 26076 - RNA, 20 nt, Artificial Sequence
  targeting sequence with TTCN PAM
caagucaaguaucaauauuu

SEQ ID NO: 26077 - RNA, 20 nt, Artificial Sequence
  targeting sequence with TTCN PAM
guucacuuucuuccuuucuc

SEQ ID NO: 26078 - RNA, 20 nt, Artificial Sequence
  targeting sequence with TTCN PAM
cuuucuuccuuucuccuuca

SEQ ID NO: 26079 - RNA, 20 nt, Artificial Sequence
  targeting sequence with TTCN PAM
uccuuucuccuucaaucgau

SEQ ID NO: 26080 - RNA, 20 nt, Artificial Sequence
  targeting sequence with TTCN PAM
uuucuccuucaaucgaugga

SEQ ID NO: 26081 - RNA, 20 nt, Artificial Sequence
  targeting sequence with TTCN PAM
ccuucaaucgauggaugcuc

SEQ ID NO: 26082 - RNA, 20 nt, Artificial Sequence
  targeting sequence with TTCN PAM
aucgauggaugcucacagaa

SEQ ID NO: 26083 - RNA, 20 nt, Artificial Sequence
  targeting sequence with TTCN PAM
gugagcauccaucgauugaa

SEQ ID NO: 26084 - RNA, 20 nt, Artificial Sequence
  targeting sequence with TTCN PAM
aauguuucugugagcaucca

SEQ ID NO: 26085 - RNA, 20 nt, Artificial Sequence
  targeting sequence with TTCN PAM
cauuuguguuuuauguucua

SEQ ID NO: 26086 - RNA, 20 nt, Artificial Sequence
  targeting sequence with TTCN PAM
cuacauguaugcauaugaag

SEQ ID NO: 26087 - RNA, 20 nt, Artificial Sequence
  targeting sequence with TTCN PAM
uaugcauacauguagugaaa

SEQ ID NO: 26088 - RNA, 20 nt, Artificial Sequence
  targeting sequence with TTCN PAM
cucccacaacauggacuucc

SEQ ID NO: 26089 - RNA, 20 nt, Artificial Sequence
  targeting sequence with TTCN PAM
uuccuacugcagaaacaguu

SEQ ID NO: 26090 - RNA, 20 nt, Artificial Sequence
  targeting sequence with TTCN PAM
uacugcagaaacaguucaca

SEQ ID NO: 26091 - RNA, 20 nt, Artificial Sequence
  targeting sequence with TTCN PAM
gcaguaggaaggaaguccau

SEQ ID NO: 26092 - RNA, 20 nt, Artificial Sequence
  targeting sequence with TTCN PAM
caggagcaggaaggcuguug

SEQ ID NO: 26093 - RNA, 20 nt, Artificial Sequence
  targeting sequence with TTCN PAM
ugcuccugugaacuguuucu

SEQ ID NO: 26094 - RNA, 20 nt, Artificial Sequence
  targeting sequence with TTCN PAM
ucaucuucucaccugaccuu

SEQ ID NO: 26095 - RNA, 20 nt, Artificial Sequence
  targeting sequence with TTCN PAM
caccugaccuuucauaauau

SEQ ID NO: 26096 - RNA, 20 nt, Artificial Sequence
  targeting sequence with TTCN PAM
uaauauacagacacucuuug

SEQ ID NO: 26097 - RNA, 20 nt, Artificial Sequence
  targeting sequence with TTCN PAM
ugaaaacaauauuucccauu

SEQ ID NO: 26098 - RNA, 20 nt, Artificial Sequence
  targeting sequence with TTCN PAM
ggaaguaaccccaucguaag

SEQ ID NO: 26099 - RNA, 20 nt, Artificial Sequence
  targeting sequence with TTCN PAM
cauuuaugaugggcuuaaau

SEQ ID NO: 26100 - RNA, 20 nt, Artificial Sequence
  targeting sequence with TTCN PAM
ugcuagagugacauacaugu

SEQ ID NO: 26101 - RNA, 20 nt, Artificial Sequence
  targeting sequence with TTCN PAM
caggacuggggccugagaua

SEQ ID NO: 26102 - RNA, 20 nt, Artificial Sequence
  targeting sequence with TTCN PAM
cuagcagcagccugugggcu

SEQ ID NO: 26103 - RNA, 20 nt, Artificial Sequence
  targeting sequence with TTCN PAM
gacccaguaugaagacagca

SEQ ID NO: 26104 - RNA, 20 nt, Artificial Sequence
  targeting sequence with TTCN PAM
uacugggucugaacaaaaaa

SEQ ID NO: 26105 - RNA, 20 nt, Artificial Sequence
  targeting sequence with TTCN PAM
ugccucauguuauuuguaaa

SEQ ID NO: 26106 - RNA, 20 nt, Artificial Sequence
  targeting sequence with TTCN PAM
ccucuuucuugccucauguu

SEQ ID NO: 26107 - RNA, 20 nt, Artificial Sequence
  targeting sequence with TTCN PAM
gucugcuguuucaccucuuu

SEQ ID NO: 26108 - RNA, 20 nt, Artificial Sequence
  targeting sequence with TTCN PAM
aaaugauauugacagauuca

SEQ ID NO: 26109 - RNA, 20 nt, Artificial Sequence
  targeting sequence with TTCN PAM
agugcagccaagacuuuacc

SEQ ID NO: 26110 - RNA, 20 nt, Artificial Sequence
  targeting sequence with TTCN PAM
auagaaauagggaacuacuu

SEQ ID NO: 26111 - RNA, 20 nt, Artificial Sequence
  targeting sequence with TTCN PAM
auagaauuaaucccugguaa

SEQ ID NO: 26112 - RNA, 20 nt, Artificial Sequence
  targeting sequence with TTCN PAM
cuauuucuauagaauuaauc

SEQ ID NO: 26113 - RNA, 20 nt, Artificial Sequence
  targeting sequence with TTCN PAM
uacugcugaauucagguauc

SEQ ID NO: 26114 - RNA, 20 nt, Artificial Sequence
  targeting sequence with TTCN PAM
gcaguaggaaguaguucccu

SEQ ID NO: 26115 - RNA, 20 nt, Artificial Sequence
  targeting sequence with TTCN PAM
gguaucaagagcucauguaa

SEQ ID NO: 26116 - RNA, 20 nt, Artificial Sequence
  targeting sequence with TTCN PAM
uuguaacuccacagaacuaa

SEQ ID NO: 26117 - RNA, 20 nt, Artificial Sequence
  targeting sequence with TTCN PAM
guggaguuacaaagaacaag

SEQ ID NO: 26118 - RNA, 20 nt, Artificial Sequence
  targeting sequence with TTCN PAM
auuuuagaaagaacuuucua

SEQ ID NO: 26119 - RNA, 20 nt, Artificial Sequence
  targeting sequence with TTCN PAM
aaaauugaacuaaagaccaa

SEQ ID NO: 26120 - RNA, 20 nt, Artificial Sequence
  targeting sequence with TTCN PAM
uucuaaaauugaacuaaaga

SEQ ID NO: 26121 - RNA, 20 nt, Artificial Sequence
  targeting sequence with TTCN PAM
aauagcuaugucuaacaaug

SEQ ID NO: 26122 - RNA, 20 nt, Artificial Sequence
  targeting sequence with TTCN PAM
uuguuagacauagcuauuag

SEQ ID NO: 26123 - RNA, 20 nt, Artificial Sequence
  targeting sequence with TTCN PAM
aagauaguuuuuuucauugu

SEQ ID NO: 26124 - RNA, 20 nt, Artificial Sequence
  targeting sequence with TTCN PAM
aggagaggcugcuugucagg

SEQ ID NO: 26125 - RNA, 20 nt, Artificial Sequence
  targeting sequence with TTCN PAM
gcaacaucccugacaagcag

SEQ ID NO: 26126 - RNA, 20 nt, Artificial Sequence
  targeting sequence with TTCN PAM
auagaggauuuauuucugca

SEQ ID NO: 26127 - RNA, 20 nt, Artificial Sequence
  targeting sequence with TTCN PAM
aacaccuagaguuugauucu

SEQ ID NO: 26128 - RNA, 20 nt, Artificial Sequence
  targeting sequence with TTCN PAM
uuguagucagggaaccuguu

SEQ ID NO: 26129 - RNA, 20 nt, Artificial Sequence
  targeting sequence with TTCN PAM
cugacuacaaagaaucaaac

SEQ ID NO: 26130 - RNA, 20 nt, Artificial Sequence
  targeting sequence with TTCN PAM
uuuuucuuucuuucuuuuuu

SEQ ID NO: 26131 - RNA, 20 nt, Artificial Sequence
  targeting sequence with TTCN PAM
uucuuucuuuuuuuuuuuuu

SEQ ID NO: 26132 - RNA, 20 nt, Artificial Sequence
  targeting sequence with TTCN PAM
uucuuuuuuuuuuuuuuuuu

SEQ ID NO: 26133 - RNA, 20 nt, Artificial Sequence
  targeting sequence with TTCN PAM
uuuuuuuuuuuuuuuuuuua

SEQ ID NO: 26134 - RNA, 20 nt, Artificial Sequence
  targeting sequence with TTCN PAM
agagcucaagggauccuccc

SEQ ID NO: 26135 - RNA, 20 nt, Artificial Sequence
  targeting sequence with TTCN PAM
gaguagcugggacuacugac

SEQ ID NO: 26136 - RNA, 20 nt, Artificial Sequence
  targeting sequence with TTCN PAM
gagacagggucucacuaugu

SEQ ID NO: 26137 - RNA, 20 nt, Artificial Sequence
  targeting sequence with TTCN PAM
agaccagccugggcaacaua

SEQ ID NO: 26138 - RNA, 20 nt, Artificial Sequence
  targeting sequence with TTCN PAM
caaagugcugagacuacagg

SEQ ID NO: 26139 - RNA, 20 nt, Artificial Sequence
  targeting sequence with TTCN PAM
ucuuucaaacuauagauacu

SEQ ID NO: 26140 - RNA, 20 nt, Artificial Sequence
  targeting sequence with TTCN PAM
aacuauagauacuuuaaauu

SEQ ID NO: 26141 - RNA, 20 nt, Artificial Sequence
  targeting sequence with TTCN PAM
caacguauugauuuuaacaa

SEQ ID NO: 26142 - RNA, 20 nt, Artificial Sequence
  targeting sequence with TTCN PAM
uaaauuaccacuauuuugug

SEQ ID NO: 26143 - RNA, 20 nt, Artificial Sequence
  targeting sequence with TTCN PAM
caccugauuuuacauaguuc

SEQ ID NO: 26144 - RNA, 20 nt, Artificial Sequence
  targeting sequence with TTCN PAM
cuugguaugugaggugguga

SEQ ID NO: 26145 - RNA, 20 nt, Artificial Sequence
  targeting sequence with TTCN PAM
ucaccaccucacauaccaag

SEQ ID NO: 26146 - RNA, 20 nt, Artificial Sequence
  targeting sequence with TTCN PAM
uauauauuccucaccaccuc

SEQ ID NO: 26147 - RNA, 20 nt, Artificial Sequence
  targeting sequence with TTCN PAM
cugauucauauauauuccuc

SEQ ID NO: 26148 - RNA, 20 nt, Artificial Sequence
  targeting sequence with TTCN PAM
caacacuuuugaaccuuaca

SEQ ID NO: 26149 - RNA, 20 nt, Artificial Sequence
  targeting sequence with TTCN PAM
aaaguguugggaauaagugc

SEQ ID NO: 26150 - RNA, 20 nt, Artificial Sequence
  targeting sequence with TTCN PAM
uaugauaaacauugguuuau

SEQ ID NO: 26151 - RNA, 20 nt, Artificial Sequence
  targeting sequence with TTCN PAM
ggaagucauuuucaaacuag

SEQ ID NO: 26152 - RNA, 20 nt, Artificial Sequence
  targeting sequence with TTCN PAM
agaaccuuugacagguuugc

SEQ ID NO: 26153 - RNA, 20 nt, Artificial Sequence
  targeting sequence with TTCN PAM
aacuagauuuugguucaucc

SEQ ID NO: 26154 - RNA, 20 nt, Artificial Sequence
  targeting sequence with TTCN PAM
ucccauauuaugucuagagg

SEQ ID NO: 26155 - RNA, 20 nt, Artificial Sequence
  targeting sequence with TTCN PAM
cuccugccauuuugcaccua

SEQ ID NO: 26156 - RNA, 20 nt, Artificial Sequence
  targeting sequence with TTCN PAM
aggugcaaaauggcaggagu

SEQ ID NO: 26157 - RNA, 20 nt, Artificial Sequence
  targeting sequence with TTCN PAM
uaaugcaguuuguaccagcu

SEQ ID NO: 26158 - RNA, 20 nt, Artificial Sequence
  targeting sequence with TTCN PAM
uccucuauaaagaggaaauc

SEQ ID NO: 26159 - RNA, 20 nt, Artificial Sequence
  targeting sequence with TTCN PAM
ucuuuauagaggaugaaaag

SEQ ID NO: 26160 - RNA, 20 nt, Artificial Sequence
  targeting sequence with TTCN PAM
ccuuuaaucuuugcaauugc

SEQ ID NO: 26161 - RNA, 20 nt, Artificial Sequence
  targeting sequence with TTCN PAM
uuuuucucuuuugugagucu

SEQ ID NO: 26162 - RNA, 20 nt, Artificial Sequence
  targeting sequence with TTCN PAM
cuuuugugagucuccuaguu

SEQ ID NO: 26163 - RNA, 20 nt, Artificial Sequence
  targeting sequence with TTCN PAM
cugucgcccagguuggagug

SEQ ID NO: 26164 - RNA, 20 nt, Artificial Sequence
  targeting sequence with TTCN PAM
accucagccucccaagcagc

SEQ ID NO: 26165 - RNA, 20 nt, Artificial Sequence
  targeting sequence with TTCN PAM
guagagacgggguuucgcca

SEQ ID NO: 26166 - RNA, 20 nt, Artificial Sequence
  targeting sequence with TTCN PAM
ccauguuacccaggcugguc

SEQ ID NO: 26167 - RNA, 20 nt, Artificial Sequence
  targeting sequence with TTCN PAM
agaccagccuggguaacaug

SEQ ID NO: 26168 - RNA, 20 nt, Artificial Sequence
  targeting sequence with TTCN PAM
uggauugaagugaucuuccu

SEQ ID NO: 26169 - RNA, 20 nt, Artificial Sequence
  targeting sequence with TTCN PAM
auccaggaauucaagaccag

SEQ ID NO: 26170 - RNA, 20 nt, Artificial Sequence
  targeting sequence with TTCN PAM
ugccuuggccucccaaagug

SEQ ID NO: 26171 - RNA, 20 nt, Artificial Sequence
  targeting sequence with TTCN PAM
uuucuuuauguccacuuucc

SEQ ID NO: 26172 - RNA, 20 nt, Artificial Sequence
  targeting sequence with TTCN PAM
uuauguccacuuucccaauu

SEQ ID NO: 26173 - RNA, 20 nt, Artificial Sequence
  targeting sequence with TTCN PAM
caauuuuauauauuuugaca

SEQ ID NO: 26174 - RNA, 20 nt, Artificial Sequence
  targeting sequence with TTCN PAM
cuguuuucaguauauuuaug

SEQ ID NO: 26175 - RNA, 20 nt, Artificial Sequence
  targeting sequence with TTCN PAM
guauauuuaugauguuuuuc

SEQ ID NO: 26176 - RNA, 20 nt, Artificial Sequence
  targeting sequence with TTCN PAM
uaugacaucacagaaauggg

SEQ ID NO: 26177 - RNA, 20 nt, Artificial Sequence
  targeting sequence with TTCN PAM
gugaugucauaggaaaaaca

SEQ ID NO: 26178 - RNA, 20 nt, Artificial Sequence
  targeting sequence with TTCN PAM
uauuucauacaucuagguuc

SEQ ID NO: 26179 - RNA, 20 nt, Artificial Sequence
  targeting sequence with TTCN PAM
uacaucuagguuccugccau

SEQ ID NO: 26180 - RNA, 20 nt, Artificial Sequence
  targeting sequence with TTCN PAM
ugccauuucccuggcucaag

SEQ ID NO: 26181 - RNA, 20 nt, Artificial Sequence
  targeting sequence with TTCN PAM
cuggcucaaguuugccagau

SEQ ID NO: 26182 - RNA, 20 nt, Artificial Sequence
  targeting sequence with TTCN PAM
aauaguuccaugcacuggcc

SEQ ID NO: 26183 - RNA, 20 nt, Artificial Sequence
  targeting sequence with TTCN PAM
augcacuggccauuuccaaa

SEQ ID NO: 26184 - RNA, 20 nt, Artificial Sequence
  targeting sequence with TTCN PAM
aaacuuuccuuuguacuggu

SEQ ID NO: 26185 - RNA, 20 nt, Artificial Sequence
  targeting sequence with TTCN PAM
uuuguacuggugaaacuauc

SEQ ID NO: 26186 - RNA, 20 nt, Artificial Sequence
  targeting sequence with TTCN PAM
ccaguacaaaggaaaguuug

SEQ ID NO: 26187 - RNA, 20 nt, Artificial Sequence
  targeting sequence with TTCN PAM
ucacacacauacauagguag

SEQ ID NO: 26188 - RNA, 20 nt, Artificial Sequence
  targeting sequence with TTCN PAM
gaggcauaaucauggugcac

SEQ ID NO: 26189 - RNA, 20 nt, Artificial Sequence
  targeting sequence with TTCN PAM
aaucuccaaaaagaguuaua

SEQ ID NO: 26190 - RNA, 20 nt, Artificial Sequence
  targeting sequence with TTCN PAM
auauaacucuuuuuggagau

SEQ ID NO: 26191 - RNA, 20 nt, Artificial Sequence
  targeting sequence with TTCN PAM
guaagagcauggugaggauu

SEQ ID NO: 26192 - RNA, 20 nt, Artificial Sequence
  targeting sequence with TTCN PAM
accucuaaaggacuuuauuu

SEQ ID NO: 26193 - RNA, 20 nt, Artificial Sequence
  targeting sequence with TTCN PAM
caguuacaugggaaauuaac

SEQ ID NO: 26194 - RNA, 20 nt, Artificial Sequence
  targeting sequence with TTCN PAM
cauguaacugugaauaaauu

SEQ ID NO: 26195 - RNA, 20 nt, Artificial Sequence
  targeting sequence with TTCN PAM
ucucaagcugagucuuccca

SEQ ID NO: 26196 - RNA, 20 nt, Artificial Sequence
  targeting sequence with TTCN PAM
caagcugagucuucccaaau

SEQ ID NO: 26197 - RNA, 20 nt, Artificial Sequence
  targeting sequence with TTCN PAM
caaauaagaaaauguaacua

SEQ ID NO: 26198 - RNA, 20 nt, Artificial Sequence
  targeting sequence with TTCN PAM
uauuugggaagacucagcuu

SEQ ID NO: 26199 - RNA, 20 nt, Artificial Sequence
  targeting sequence with TTCN PAM
cagagauaaugcuuuguuag

SEQ ID NO: 26200 - RNA, 20 nt, Artificial Sequence
  targeting sequence with TTCN PAM
acuuacccaaaugcugcuuu

SEQ ID NO: 26201 - RNA, 20 nt, Artificial Sequence
  targeting sequence with TTCN PAM
ucugcugagaucauucuacu

SEQ ID NO: 26202 - RNA, 20 nt, Artificial Sequence
  targeting sequence with TTCN PAM
ugcucugucacccagacugg

SEQ ID NO: 26203 - RNA, 20 nt, Artificial Sequence
  targeting sequence with TTCN PAM
guuuguuugagacagguucu

SEQ ID NO: 26204 - RNA, 20 nt, Artificial Sequence
  targeting sequence with TTCN PAM
gggacuccuguuuuuguuug

SEQ ID NO: 26205 - RNA, 20 nt, Artificial Sequence
  targeting sequence with TTCN PAM
gauccuuauuaaaccucacu

SEQ ID NO: 26206 - RNA, 20 nt, Artificial Sequence
  targeting sequence with TTCN PAM
gaccagcuugggcaacaugg

SEQ ID NO: 26207 - RNA, 20 nt, Artificial Sequence
  targeting sequence with TTCN PAM
ccauguugcccaagcugguc

SEQ ID NO: 26208 - RNA, 20 nt, Artificial Sequence
  targeting sequence with TTCN PAM
gcauggaaggcagaggugca

SEQ ID NO: 26209 - RNA, 20 nt, Artificial Sequence
  targeting sequence with TTCN PAM
augcugaagcaguccucuca

SEQ ID NO: 26210 - RNA, 20 nt, Artificial Sequence
  targeting sequence with TTCN PAM
cuuugagacaaggucuuacu

SEQ ID NO: 26211 - RNA, 20 nt, Artificial Sequence
  targeting sequence with TTCN PAM
guauuguuaaugaaaugcaa

SEQ ID NO: 26212 - RNA, 20 nt, Artificial Sequence
  targeting sequence with TTCN PAM
uuaacaauacagaauuuuuu

SEQ ID NO: 26213 - RNA, 20 nt, Artificial Sequence
  targeting sequence with TTCN PAM
uuauuugcauuucauuaaca

SEQ ID NO: 26214 - RNA, 20 nt, Artificial Sequence
  targeting sequence with TTCN PAM
uuucguuauuugcauuucau

SEQ ID NO: 26215 - RNA, 20 nt, Artificial Sequence
  targeting sequence with TTCN PAM
aguucccacugacuucccac

SEQ ID NO: 26216 - RNA, 20 nt, Artificial Sequence
  targeting sequence with TTCN PAM
cacugacuucccacuauccc

SEQ ID NO: 26217 - RNA, 20 nt, Artificial Sequence
  targeting sequence with TTCN PAM
cacuauccccauuacuaaua

SEQ ID NO: 26218 - RNA, 20 nt, Artificial Sequence
  targeting sequence with TTCN PAM
uagcacacuuuauuuucuag

SEQ ID NO: 26219 - RNA, 20 nt, Artificial Sequence
  targeting sequence with TTCN PAM
aguguuuacuuccugucuaa

SEQ ID NO: 26220 - RNA, 20 nt, Artificial Sequence
  targeting sequence with TTCN PAM
ugucuaaauucuaaaaugga

SEQ ID NO: 26221 - RNA, 20 nt, Artificial Sequence
  targeting sequence with TTCN PAM
aaaauggagaaaccagguac

SEQ ID NO: 26222 - RNA, 20 nt, Artificial Sequence
  targeting sequence with TTCN PAM
ccauuuuagaauuuagacag

SEQ ID NO: 26223 - RNA, 20 nt, Artificial Sequence
  targeting sequence with TTCN PAM
cauuaaauauuaacaccaag

SEQ ID NO: 26224 - RNA, 20 nt, Artificial Sequence
  targeting sequence with TTCN PAM
ccccuacuguuuggcuuggu

SEQ ID NO: 26225 - RNA, 20 nt, Artificial Sequence
  targeting sequence with TTCN PAM
cuuuuucuccccuacuguuu

SEQ ID NO: 26226 - RNA, 20 nt, Artificial Sequence
  targeting sequence with TTCN PAM
uaugugaaagucuuggguuu

SEQ ID NO: 26227 - RNA, 20 nt, Artificial Sequence
  targeting sequence with TTCN PAM
cauaugaaagucuauaaaac

SEQ ID NO: 26228 - RNA, 20 nt, Artificial Sequence
  targeting sequence with TTCN PAM
agguuuaaaaaaaacccaag

SEQ ID NO: 26229 - RNA, 20 nt, Artificial Sequence
  targeting sequence with TTCN PAM
uuaaagcagaguucuagguu

SEQ ID NO: 26230 - RNA, 20 nt, Artificial Sequence
  targeting sequence with TTCN PAM
auuuagcauccuguaaaggg

SEQ ID NO: 26231 - RNA, 20 nt, Artificial Sequence
  targeting sequence with TTCN PAM
uaaucauacaagaacaguca

SEQ ID NO: 26232 - RNA, 20 nt, Artificial Sequence
  targeting sequence with TTCN PAM
uguaugauuaagaaccuccc

SEQ ID NO: 26233 - RNA, 20 nt, Artificial Sequence
  targeting sequence with TTCN PAM
caagauguguccccaucauu

SEQ ID NO: 26234 - RNA, 20 nt, Artificial Sequence
  targeting sequence with TTCN PAM
cauagugauaaaauaacgua

SEQ ID NO: 26235 - RNA, 20 nt, Artificial Sequence
  targeting sequence with TTCN PAM
uaggcuacaaagcuguacag

SEQ ID NO: 26236 - RNA, 20 nt, Artificial Sequence
  targeting sequence with TTCN PAM
auguuuagauaugucuagau

SEQ ID NO: 26237 - RNA, 20 nt, Artificial Sequence
  targeting sequence with TTCN PAM
aagcagcugggauuacaggc

SEQ ID NO: 26238 - RNA, 20 nt, Artificial Sequence
  targeting sequence with TTCN PAM
agcaauugucgugccucagc

SEQ ID NO: 26239 - RNA, 20 nt, Artificial Sequence
  targeting sequence with TTCN PAM
gugagccgagacuguaccac

SEQ ID NO: 26240 - RNA, 20 nt, Artificial Sequence
  targeting sequence with TTCN PAM
uaaguuuauaaugcuguuuu

SEQ ID NO: 26241 - RNA, 20 nt, Artificial Sequence
  targeting sequence with TTCN PAM
gcacaugacuaugugugauu

SEQ ID NO: 26242 - RNA, 20 nt, Artificial Sequence
  targeting sequence with TTCN PAM
cgcaccuccgcuuggauuac

SEQ ID NO: 26243 - RNA, 20 nt, Artificial Sequence
  targeting sequence with TTCN PAM
uaaauuguuacaacccaaag

SEQ ID NO: 26244 - RNA, 20 nt, Artificial Sequence
  targeting sequence with TTCN PAM
cuuuggguuguaacaauuua

SEQ ID NO: 26245 - RNA, 20 nt, Artificial Sequence
  targeting sequence with TTCN PAM
guuugcugauaguuaagcuc

SEQ ID NO: 26246 - RNA, 20 nt, Artificial Sequence
  targeting sequence with TTCN PAM
aaaagcaaguaucauauuuu

SEQ ID NO: 26247 - RNA, 20 nt, Artificial Sequence
  targeting sequence with TTCN PAM
ucuaccaaaauaugauacuu

SEQ ID NO: 26248 - RNA, 20 nt, Artificial Sequence
  targeting sequence with TTCN PAM
ucccccacuggaagcaaaac

SEQ ID NO: 26249 - RNA, 20 nt, Artificial Sequence
  targeting sequence with TTCN PAM
agugggggaugaauuucauc

SEQ ID NO: 26250 - RNA, 20 nt, Artificial Sequence
  targeting sequence with TTCN PAM
aucuacaaaguauuaaacac

SEQ ID NO: 26251 - RNA, 20 nt, Artificial Sequence
  targeting sequence with TTCN PAM
uaaauaaauacuaaacuuga

SEQ ID NO: 26252 - RNA, 20 nt, Artificial Sequence
  targeting sequence with TTCN PAM
aguuuaguauuuauuuauga

SEQ ID NO: 26253 - RNA, 20 nt, Artificial Sequence
  targeting sequence with TTCN PAM
uagaucagagaugagccagg

SEQ ID NO: 26254 - RNA, 20 nt, Artificial Sequence
  targeting sequence with TTCN PAM
ucaguaauuugacacaaaag

SEQ ID NO: 26255 - RNA, 20 nt, Artificial Sequence
  targeting sequence with TTCN PAM
caggcuguguacucacccag

SEQ ID NO: 26256 - RNA, 20 nt, Artificial Sequence
  targeting sequence with TTCN PAM
ggucaaagcauucccaggcu

SEQ ID NO: 26257 - RNA, 20 nt, Artificial Sequence
  targeting sequence with TTCN PAM
ucuuuggguguggcucaaaa

SEQ ID NO: 26258 - RNA, 20 nt, Artificial Sequence
  targeting sequence with TTCN PAM
cagagauggcuccaaacuuu

SEQ ID NO: 26259 - RNA, 20 nt, Artificial Sequence
  targeting sequence with TTCN PAM
cuaguucggcaauaggucac

SEQ ID NO: 26260 - RNA, 20 nt, Artificial Sequence
  targeting sequence with TTCN PAM
gcaauaggucacuagcacag

SEQ ID NO: 26261 - RNA, 20 nt, Artificial Sequence
  targeting sequence with TTCN PAM
gcuauccugugcuagugacc

SEQ ID NO: 26262 - RNA, 20 nt, Artificial Sequence
  targeting sequence with TTCN PAM
ucagcuauccugugcuagug

SEQ ID NO: 26263 - RNA, 20 nt, Artificial Sequence
  targeting sequence with TTCN PAM
cucaauaccugcuccacaag

SEQ ID NO: 26264 - RNA, 20 nt, Artificial Sequence
  targeting sequence with TTCN PAM
uguuucucucaauaccugcu

SEQ ID NO: 26265 - RNA, 20 nt, Artificial Sequence
  targeting sequence with TTCN PAM
uccuguuucucucaauaccu

SEQ ID NO: 26266 - RNA, 20 nt, Artificial Sequence
  targeting sequence with TTCN PAM
ugggaccuaguucuuccugu

SEQ ID NO: 26267 - RNA, 20 nt, Artificial Sequence
  targeting sequence with TTCN PAM
cccauaguugccugugggug

SEQ ID NO: 26268 - RNA, 20 nt, Artificial Sequence
  targeting sequence with TTCN PAM
ucucccauaguugccugugg

SEQ ID NO: 26269 - RNA, 20 nt, Artificial Sequence
  targeting sequence with TTCN PAM
caaaugcauaccagagaccc

SEQ ID NO: 26270 - RNA, 20 nt, Artificial Sequence
  targeting sequence with TTCN PAM
gccaguguuugaccagagua

SEQ ID NO: 26271 - RNA, 20 nt, Artificial Sequence
  targeting sequence with TTCN PAM
aacucccaccgcaagucaua

SEQ ID NO: 26272 - RNA, 20 nt, Artificial Sequence
  targeting sequence with TTCN PAM
uagcugaauuggggagagug

SEQ ID NO: 26273 - RNA, 20 nt, Artificial Sequence
  targeting sequence with TTCN PAM
gcuaggaaccuauucaaacu

SEQ ID NO: 26274 - RNA, 20 nt, Artificial Sequence
  targeting sequence with TTCN PAM
ccuuaccuuuuguuaccuuu

SEQ ID NO: 26275 - RNA, 20 nt, Artificial Sequence
  targeting sequence with TTCN PAM
acacaaaaaagguaacaaaa

SEQ ID NO: 26276 - RNA, 20 nt, Artificial Sequence
  targeting sequence with TTCN PAM
ggcuucaacacaaaaaaggu

SEQ ID NO: 26277 - RNA, 20 nt, Artificial Sequence
  targeting sequence with TTCN PAM
uuucaggcuucaacacaaaa

SEQ ID NO: 26278 - RNA, 20 nt, Artificial Sequence
  targeting sequence with TTCN PAM
guguuuuuuagcuucuuuuc

SEQ ID NO: 26279 - RNA, 20 nt, Artificial Sequence
  targeting sequence with TTCN PAM
gcugaaaagggaaaaagaua

SEQ ID NO: 26280 - RNA, 20 nt, Artificial Sequence
  targeting sequence with TTCN PAM
gcugaaggcuaguucagugu

SEQ ID NO: 26281 - RNA, 20 nt, Artificial Sequence
  targeting sequence with TTCN PAM
cuuuucagcugaaggcuagu

SEQ ID NO: 26282 - RNA, 20 nt, Artificial Sequence
  targeting sequence with TTCN PAM
aggguaggcaaugaauuauc

SEQ ID NO: 26283 - RNA, 20 nt, Artificial Sequence
  targeting sequence with TTCN PAM
uugccuacccuugaaauauu

SEQ ID NO: 26284 - RNA, 20 nt, Artificial Sequence
  targeting sequence with TTCN PAM
ugucauuaagauaauucauu

SEQ ID NO: 26285 - RNA, 20 nt, Artificial Sequence
  targeting sequence with TTCN PAM
uguauuauuuagauauuuac

SEQ ID NO: 26286 - RNA, 20 nt, Artificial Sequence
  targeting sequence with TTCN PAM
gggcaacuugcagacuuggu

SEQ ID NO: 26287 - RNA, 20 nt, Artificial Sequence
  targeting sequence with TTCN PAM
aacauucuggcacaacccag

SEQ ID NO: 26288 - RNA, 20 nt, Artificial Sequence
  targeting sequence with TTCN PAM
ggcacaacccagaucuuugu

SEQ ID NO: 26289 - RNA, 20 nt, Artificial Sequence
  targeting sequence with TTCN PAM
ccuagaaaaaauggaggagg

SEQ ID NO: 26290 - RNA, 20 nt, Artificial Sequence
  targeting sequence with TTCN PAM
aggggaauacaaagaucugg

SEQ ID NO: 26291 - RNA, 20 nt, Artificial Sequence
  targeting sequence with TTCN PAM
auauauguuaucuccuuuaa

SEQ ID NO: 26292 - RNA, 20 nt, Artificial Sequence
  targeting sequence with TTCN PAM
acaaccauguacaauaaaua

SEQ ID NO: 26293 - RNA, 20 nt, Artificial Sequence
  targeting sequence with TTCN PAM
cccucuguaaaaauguaaug

SEQ ID NO: 26294 - RNA, 20 nt, Artificial Sequence
  targeting sequence with TTCN PAM
aguuuguccacuccaaggaa

SEQ ID NO: 26295 - RNA, 20 nt, Artificial Sequence
  targeting sequence with TTCN PAM
uuggaguggacaaacuugaa

SEQ ID NO: 26296 - RNA, 20 nt, Artificial Sequence
  targeting sequence with TTCN PAM
ucuuuagcggcuaaacgcua

SEQ ID NO: 26297 - RNA, 20 nt, Artificial Sequence
  targeting sequence with TTCN PAM
auaaaagagauuuaugggug

SEQ ID NO: 26298 - RNA, 20 nt, Artificial Sequence
  targeting sequence with TTCN PAM
uaauugggauuuugcuucuc

SEQ ID NO: 26299 - RNA, 20 nt, Artificial Sequence
  targeting sequence with TTCN PAM
cucauaaaugaagggcuaau

SEQ ID NO: 26300 - RNA, 20 nt, Artificial Sequence
  targeting sequence with TTCN PAM
uuuaugagagaagcaaaauc

SEQ ID NO: 26301 - RNA, 20 nt, Artificial Sequence
  targeting sequence with TTCN PAM
guacccucaguuucuauuuc

SEQ ID NO: 26302 - RNA, 20 nt, Artificial Sequence
  targeting sequence with TTCN PAM
auuucaaacuuauuguccaa

SEQ ID NO: 26303 - RNA, 20 nt, Artificial Sequence
  targeting sequence with TTCN PAM
aacuuauuguccaaaucuag

SEQ ID NO: 26304 - RNA, 20 nt, Artificial Sequence
  targeting sequence with TTCN PAM
cagaucacuuuucaguugac

SEQ ID NO: 26305 - RNA, 20 nt, Artificial Sequence
  targeting sequence with TTCN PAM
guugacaggucucacacaua

SEQ ID NO: 26306 - RNA, 20 nt, Artificial Sequence
  targeting sequence with TTCN PAM
augugugagaccugucaacu

SEQ ID NO: 26307 - RNA, 20 nt, Artificial Sequence
  targeting sequence with TTCN PAM
aacuaaacaaaugguuguuu

SEQ ID NO: 26308 - RNA, 20 nt, Artificial Sequence
  targeting sequence with TTCN PAM
acugcaugugacaacugcuc

SEQ ID NO: 26309 - RNA, 20 nt, Artificial Sequence
  targeting sequence with TTCN PAM
cagaagccgauuuccaaugg

SEQ ID NO: 26310 - RNA, 20 nt, Artificial Sequence
  targeting sequence with TTCN PAM
gagaaaguuuguauuaaacc

SEQ ID NO: 26311 - RNA, 20 nt, Artificial Sequence
  targeting sequence with TTCN PAM
aauggacaguaauccccuuc

SEQ ID NO: 26312 - RNA, 20 nt, Artificial Sequence
  targeting sequence with TTCN PAM
aauacaagcuuucaaaaugg

SEQ ID NO: 26313 - RNA, 20 nt, Artificial Sequence
  targeting sequence with TTCN PAM
aaauggcauuaaugcucauc

SEQ ID NO: 26314 - RNA, 20 nt, Artificial Sequence
  targeting sequence with TTCN PAM
aggccagauccccuaagaaa

SEQ ID NO: 26315 - RNA, 20 nt, Artificial Sequence
  targeting sequence with TTCN PAM
uaggggaucuggccuggaau

SEQ ID NO: 26316 - RNA, 20 nt, Artificial Sequence
  targeting sequence with TTCN PAM
uugguaguuuuuuucuuagg

SEQ ID NO: 26317 - RNA, 20 nt, Artificial Sequence
  targeting sequence with TTCN PAM
caauuaauguuuuccuagcu

SEQ ID NO: 26318 - RNA, 20 nt, Artificial Sequence
  targeting sequence with TTCN PAM
uagcucucucuuauuuucag

SEQ ID NO: 26319 - RNA, 20 nt, Artificial Sequence
  targeting sequence with TTCN PAM
guacauuuugccacagcuga

SEQ ID NO: 26320 - RNA, 20 nt, Artificial Sequence
  targeting sequence with TTCN PAM
gcuguggcaaaauguacuga

SEQ ID NO: 26321 - RNA, 20 nt, Artificial Sequence
  targeting sequence with TTCN PAM
uuuugguagccuauuaauau

SEQ ID NO: 26322 - RNA, 20 nt, Artificial Sequence
  targeting sequence with TTCN PAM
uguagugaguguaaauauau

SEQ ID NO: 26323 - RNA, 20 nt, Artificial Sequence
  targeting sequence with TTCN PAM
agcagcaaauuaaauauaug

SEQ ID NO: 26324 - RNA, 20 nt, Artificial Sequence
  targeting sequence with TTCN PAM
gagcuucaguguucucaacu

SEQ ID NO: 26325 - RNA, 20 nt, Artificial Sequence
  targeting sequence with TTCN PAM
guguucucaacuguaaauaa

SEQ ID NO: 26326 - RNA, 20 nt, Artificial Sequence
  targeting sequence with TTCN PAM
caacuguaaauaagauuaau

SEQ ID NO: 26327 - RNA, 20 nt, Artificial Sequence
  targeting sequence with TTCN PAM
acuucugaaguacugugaac

SEQ ID NO: 26328 - RNA, 20 nt, Artificial Sequence
  targeting sequence with TTCN PAM
gaaguacugugaacccagcu

SEQ ID NO: 26329 - RNA, 20 nt, Artificial Sequence
  targeting sequence with TTCN PAM
gaaguagaagggacccuuag

SEQ ID NO: 26330 - RNA, 20 nt, Artificial Sequence
  targeting sequence with TTCN PAM
caguacuucagaaguagaag

SEQ ID NO: 26331 - RNA, 20 nt, Artificial Sequence
  targeting sequence with TTCN PAM
ucccauguuuuguuaguggc

SEQ ID NO: 26332 - RNA, 20 nt, Artificial Sequence
  targeting sequence with TTCN PAM
ucaucccauguuuuguuagu

SEQ ID NO: 26333 - RNA, 20 nt, Artificial Sequence
  targeting sequence with TTCN PAM
uguccaguuaguuucuucau

SEQ ID NO: 26334 - RNA, 20 nt, Artificial Sequence
  targeting sequence with TTCN PAM
gauucuuguccaguuaguuu

SEQ ID NO: 26335 - RNA, 20 nt, Artificial Sequence
  targeting sequence with TTCN PAM
aaaccuugucuccugccuuc

SEQ ID NO: 26336 - RNA, 20 nt, Artificial Sequence
  targeting sequence with TTCN PAM
ccaaauacaugaucucacuc

SEQ ID NO: 26337 - RNA, 20 nt, Artificial Sequence
  targeting sequence with TTCN PAM
gcuaugagugagaucaugua

SEQ ID NO: 26338 - RNA, 20 nt, Artificial Sequence
  targeting sequence with TTCN PAM
gauccaagcucugcuacaau

SEQ ID NO: 26339 - RNA, 20 nt, Artificial Sequence
  targeting sequence with TTCN PAM
ugggcuaagugcaugugggc

SEQ ID NO: 26340 - RNA, 20 nt, Artificial Sequence
  targeting sequence with TTCN PAM
uugcccacaugcacuuagcc

SEQ ID NO: 26341 - RNA, 20 nt, Artificial Sequence
  targeting sequence with TTCN PAM
cccacauaauuguaccauga

SEQ ID NO: 26342 - RNA, 20 nt, Artificial Sequence
  targeting sequence with TTCN PAM
aaagccuauagagcacaguc

SEQ ID NO: 26343 - RNA, 20 nt, Artificial Sequence
  targeting sequence with TTCN PAM
gauuauuccagaguuaggca

SEQ ID NO: 26344 - RNA, 20 nt, Artificial Sequence
  targeting sequence with TTCN PAM
agaguuaggcagauggucuu

SEQ ID NO: 26345 - RNA, 20 nt, Artificial Sequence
  targeting sequence with TTCN PAM
cuuggagcuacucacuuggg

SEQ ID NO: 26346 - RNA, 20 nt, Artificial Sequence
  targeting sequence with TTCN PAM
auugcugucuacccaaguga

SEQ ID NO: 26347 - RNA, 20 nt, Artificial Sequence
  targeting sequence with TTCN PAM
cuuaauguguuuccauugcu

SEQ ID NO: 26348 - RNA, 20 nt, Artificial Sequence
  targeting sequence with TTCN PAM
caauaauguccuucgcuuaa

SEQ ID NO: 26349 - RNA, 20 nt, Artificial Sequence
  targeting sequence with TTCN PAM
gagaaggggaaauaaugacc

SEQ ID NO: 26350 - RNA, 20 nt, Artificial Sequence
  targeting sequence with TTCN PAM
cagaaucccuucucaauaau

SEQ ID NO: 26351 - RNA, 20 nt, Artificial Sequence
  targeting sequence with TTCN PAM
ccuucucagaaucccuucuc

SEQ ID NO: 26352 - RNA, 20 nt, Artificial Sequence
  targeting sequence with TTCN PAM
gucauuauuuccccuucuca

SEQ ID NO: 26353 - RNA, 20 nt, Artificial Sequence
  targeting sequence with TTCN PAM
uuaagaagguuucaccuauu

SEQ ID NO: 26354 - RNA, 20 nt, Artificial Sequence
  targeting sequence with TTCN PAM
uaaggaaaucccuacuucgg

SEQ ID NO: 26355 - RNA, 20 nt, Artificial Sequence
  targeting sequence with TTCN PAM
ccuauuuauuuacacugcug

SEQ ID NO: 26356 - RNA, 20 nt, Artificial Sequence
  targeting sequence with TTCN PAM
uaggccaguacagcagugua

SEQ ID NO: 26357 - RNA, 20 nt, Artificial Sequence
  targeting sequence with TTCN PAM
agagcuugcauauucauagc

SEQ ID NO: 26358 - RNA, 20 nt, Artificial Sequence
  targeting sequence with TTCN PAM
uagcauuuuuauaaaauaug

SEQ ID NO: 26359 - RNA, 20 nt, Artificial Sequence
  targeting sequence with TTCN PAM
acuugggauaggccuaauac

SEQ ID NO: 26360 - RNA, 20 nt, Artificial Sequence
  targeting sequence with TTCN PAM
gagagcuaggcuuucaacca

SEQ ID NO: 26361 - RNA, 20 nt, Artificial Sequence
  targeting sequence with TTCN PAM
accauauagauuucgggauu

SEQ ID NO: 26362 - RNA, 20 nt, Artificial Sequence
  targeting sequence with TTCN PAM
ggauugagcuuugaaaaaaa

SEQ ID NO: 26363 - RNA, 20 nt, Artificial Sequence
  targeting sequence with TTCN PAM
aagcucaaucccgaaaucua

SEQ ID NO: 26364 - RNA, 20 nt, Artificial Sequence
  targeting sequence with TTCN PAM
uaccaggaugauuuuuuuca

SEQ ID NO: 26365 - RNA, 20 nt, Artificial Sequence
  targeting sequence with TTCN PAM
guguuauuuucauaccagga

SEQ ID NO: 26366 - RNA, 20 nt, Artificial Sequence
  targeting sequence with TTCN PAM
aauucaguguuauuuucaua

SEQ ID NO: 26367 - RNA, 20 nt, Artificial Sequence
  targeting sequence with TTCN PAM
aaacccaguuuugucugacu

SEQ ID NO: 26368 - RNA, 20 nt, Artificial Sequence
  targeting sequence with TTCN PAM
auuuccucaucuuuaaaaug

SEQ ID NO: 26369 - RNA, 20 nt, Artificial Sequence
  targeting sequence with TTCN PAM
ucaucuuuaaaaugggaaua

SEQ ID NO: 26370 - RNA, 20 nt, Artificial Sequence
  targeting sequence with TTCN PAM
cauuuuaaagaugaggaaau

SEQ ID NO: 26371 - RNA, 20 nt, Artificial Sequence
  targeting sequence with TTCN PAM
ugguaguggccuugucacca

SEQ ID NO: 26372 - RNA, 20 nt, Artificial Sequence
  targeting sequence with TTCN PAM
acgcuuuaguuuauuuuacu

SEQ ID NO: 26373 - RNA, 20 nt, Artificial Sequence
  targeting sequence with TTCN PAM
uggucacagaaggaucugug

SEQ ID NO: 26374 - RNA, 20 nt, Artificial Sequence
  targeting sequence with TTCN PAM
gugaccaagaaccaguuaau

SEQ ID NO: 26375 - RNA, 20 nt, Artificial Sequence
  targeting sequence with TTCN PAM
cagauccuucugugaccaag

SEQ ID NO: 26376 - RNA, 20 nt, Artificial Sequence
  targeting sequence with TTCN PAM
uccuacacaaaaagcaaagc

SEQ ID NO: 26377 - RNA, 20 nt, Artificial Sequence
  targeting sequence with TTCN PAM
uacacaaaaagcaaagccua

SEQ ID NO: 26378 - RNA, 20 nt, Artificial Sequence
  targeting sequence with TTCN PAM
acucuguuguaggcuuugcu

SEQ ID NO: 26379 - RNA, 20 nt, Artificial Sequence
  targeting sequence with TTCN PAM
acuucuacucuguuguaggc

SEQ ID NO: 26380 - RNA, 20 nt, Artificial Sequence
  targeting sequence with TTCN PAM
ccacacuguuagugagcuac

SEQ ID NO: 26381 - RNA, 20 nt, Artificial Sequence
  targeting sequence with TTCN PAM
ucuccacacuguuagugagc

SEQ ID NO: 26382 - RNA, 20 nt, Artificial Sequence
  targeting sequence with TTCN PAM
auuucuucuccacacuguua

SEQ ID NO: 26383 - RNA, 20 nt, Artificial Sequence
  targeting sequence with TTCN PAM
ccuuuccauuucuucuccac

SEQ ID NO: 26384 - RNA, 20 nt, Artificial Sequence
  targeting sequence with TTCN PAM
guuugucugcuuuuuuuaua

SEQ ID NO: 26385 - RNA, 20 nt, Artificial Sequence
  targeting sequence with TTCN PAM
cuaaccugagaguaucacuc

SEQ ID NO: 26386 - RNA, 20 nt, Artificial Sequence
  targeting sequence with TTCN PAM
gcuuagagugauacucucag

SEQ ID NO: 26387 - RNA, 20 nt, Artificial Sequence
  targeting sequence with TTCN PAM
auuaaguuagauucagugua

SEQ ID NO: 26388 - RNA, 20 nt, Artificial Sequence
  targeting sequence with TTCN PAM
guguacuuuguaaaagaagg

SEQ ID NO: 26389 - RNA, 20 nt, Artificial Sequence
  targeting sequence with TTCN PAM
uuuacaaaguacacugaauc

SEQ ID NO: 26390 - RNA, 20 nt, Artificial Sequence
  targeting sequence with TTCN PAM
cugccuucuuuuacaaagua

SEQ ID NO: 26391 - RNA, 20 nt, Artificial Sequence
  targeting sequence with TTCN PAM
ccaaaaugcuuaaaauguga

SEQ ID NO: 26392 - RNA, 20 nt, Artificial Sequence
  targeting sequence with TTCN PAM
cauuuuaagcauuuugggga

SEQ ID NO: 26393 - RNA, 20 nt, Artificial Sequence
  targeting sequence with TTCN PAM
gugcuuaaaauagguuucug

SEQ ID NO: 26394 - RNA, 20 nt, Artificial Sequence
  targeting sequence with TTCN PAM
ggccgggcaugguggcucau

SEQ ID NO: 26395 - RNA, 20 nt, Artificial Sequence
  targeting sequence with TTCN PAM
agaccagccuggcuaacaug

SEQ ID NO: 26396 - RNA, 20 nt, Artificial Sequence
  targeting sequence with TTCN PAM
ccugccuuagccuccccagu

SEQ ID NO: 26397 - RNA, 20 nt, Artificial Sequence
  targeting sequence with TTCN PAM
agugauucuccugccuuagc

SEQ ID NO: 26398 - RNA, 20 nt, Artificial Sequence
  targeting sequence with TTCN PAM
cucuuguugcccaggcugga

SEQ ID NO: 26399 - RNA, 20 nt, Artificial Sequence
  targeting sequence with TTCN PAM
uuguuuuuggagacagaguu

SEQ ID NO: 26400 - RNA, 20 nt, Artificial Sequence
  targeting sequence with TTCN PAM
uuuuguuuuuuuguucuuug

SEQ ID NO: 26401 - RNA, 20 nt, Artificial Sequence
  targeting sequence with TTCN PAM
aagccaggcaugguggcaug

SEQ ID NO: 26402 - RNA, 20 nt, Artificial Sequence
  targeting sequence with TTCN PAM
accucagccuccugaguagc

SEQ ID NO: 26403 - RNA, 20 nt, Artificial Sequence
  targeting sequence with TTCN PAM
agaccagcaaggcaacauag

SEQ ID NO: 26404 - RNA, 20 nt, Artificial Sequence
  targeting sequence with TTCN PAM
agcaauucuccugccucagc

SEQ ID NO: 26405 - RNA, 20 nt, Artificial Sequence
  targeting sequence with TTCN PAM
ccugccucagccucccccgu

SEQ ID NO: 26406 - RNA, 20 nt, Artificial Sequence
  targeting sequence with TTCN PAM
ccauguuagccaggaugguc

SEQ ID NO: 26407 - RNA, 20 nt, Artificial Sequence
  targeting sequence with TTCN PAM
gaccuugugauccacccacc

SEQ ID NO: 26408 - RNA, 20 nt, Artificial Sequence
  targeting sequence with TTCN PAM
cuuuucuguuagaacuuuug

SEQ ID NO: 26409 - RNA, 20 nt, Artificial Sequence
  targeting sequence with TTCN PAM
guuagaacuuuuggagccca

SEQ ID NO: 26410 - RNA, 20 nt, Artificial Sequence
  targeting sequence with TTCN PAM
aacagaaaagggaauaugug

SEQ ID NO: 26411 - RNA, 20 nt, Artificial Sequence
  targeting sequence with TTCN PAM
gggcuccaaaaguucuaaca

SEQ ID NO: 26412 - RNA, 20 nt, Artificial Sequence
  targeting sequence with TTCN PAM
uugaaguugcaaucagggua

SEQ ID NO: 26413 - RNA, 20 nt, Artificial Sequence
  targeting sequence with TTCN PAM
aggaaaagaucuuuucuggg

SEQ ID NO: 26414 - RNA, 20 nt, Artificial Sequence
  targeting sequence with TTCN PAM
aacagauaaugugcaugagg

SEQ ID NO: 26415 - RNA, 20 nt, Artificial Sequence
  targeting sequence with TTCN PAM
acacuccuuagaaaugauuc

SEQ ID NO: 26416 - RNA, 20 nt, Artificial Sequence
  targeting sequence with TTCN PAM
aaggaguguagaagccuaau

SEQ ID NO: 26417 - RNA, 20 nt, Artificial Sequence
  targeting sequence with TTCN PAM
cuauaaacuuuucuucacaa

SEQ ID NO: 26418 - RNA, 20 nt, Artificial Sequence
  targeting sequence with TTCN PAM
ucacaaguuuccacugaaca

SEQ ID NO: 26419 - RNA, 20 nt, Artificial Sequence
  targeting sequence with TTCN PAM
caaguuuccacugaacauaa

SEQ ID NO: 26420 - RNA, 20 nt, Artificial Sequence
  targeting sequence with TTCN PAM
acugaacauaaaauacauuc

SEQ ID NO: 26421 - RNA, 20 nt, Artificial Sequence
  targeting sequence with TTCN PAM
guggaaacuugugaagaaaa

SEQ ID NO: 26422 - RNA, 20 nt, Artificial Sequence
  targeting sequence with TTCN PAM
uccacccaucuaucaaucua

SEQ ID NO: 26423 - RNA, 20 nt, Artificial Sequence
  targeting sequence with TTCN PAM
acccaucuaucaaucuaaac

SEQ ID NO: 26424 - RNA, 20 nt, Artificial Sequence
  targeting sequence with TTCN PAM
ccacauauccuuagacuuca

SEQ ID NO: 26425 - RNA, 20 nt, Artificial Sequence
  targeting sequence with TTCN PAM
aacaaccaguucacauuuca

SEQ ID NO: 26426 - RNA, 20 nt, Artificial Sequence
  targeting sequence with TTCN PAM
cauuucauuaagaggaaaug

SEQ ID NO: 26427 - RNA, 20 nt, Artificial Sequence
  targeting sequence with TTCN PAM
uuaagaggaaaugagaauua

SEQ ID NO: 26428 - RNA, 20 nt, Artificial Sequence
  targeting sequence with TTCN PAM
ucuuaaugaaaugugaacug

SEQ ID NO: 26429 - RNA, 20 nt, Artificial Sequence
  targeting sequence with TTCN PAM
cauuuccucuuaaugaaaug

SEQ ID NO: 26430 - RNA, 20 nt, Artificial Sequence
  targeting sequence with TTCN PAM
ugggcuuacagagcucaaaa

SEQ ID NO: 26431 - RNA, 20 nt, Artificial Sequence
  targeting sequence with TTCN PAM
auuuuacuuaucugaaaaau

SEQ ID NO: 26432 - RNA, 20 nt, Artificial Sequence
  targeting sequence with TTCN PAM
gauaaguaaaauggaaaauu

SEQ ID NO: 26433 - RNA, 20 nt, Artificial Sequence
  targeting sequence with TTCN PAM
auaccuaaaauacagggagu

SEQ ID NO: 26434 - RNA, 20 nt, Artificial Sequence
  targeting sequence with TTCN PAM
uuuuuuuucucacucuuaca

SEQ ID NO: 26435 - RNA, 20 nt, Artificial Sequence
  targeting sequence with TTCN PAM
cacucuuacacaggagcuag

SEQ ID NO: 26436 - RNA, 20 nt, Artificial Sequence
  targeting sequence with TTCN PAM
uguuuguaguccuagcuccu

SEQ ID NO: 26437 - RNA, 20 nt, Artificial Sequence
  targeting sequence with TTCN PAM
cuguuacuguaauugucauc

SEQ ID NO: 26438 - RNA, 20 nt, Artificial Sequence
  targeting sequence with TTCN PAM
gagauacuuucucuguuacu

SEQ ID NO: 26439 - RNA, 20 nt, Artificial Sequence
  targeting sequence with TTCN PAM
uugucuuuucugaagacaaa

SEQ ID NO: 26440 - RNA, 20 nt, Artificial Sequence
  targeting sequence with TTCN PAM
gaagacaaauguuuuccuuu

SEQ ID NO: 26441 - RNA, 20 nt, Artificial Sequence
  targeting sequence with TTCN PAM
gaaaagacaaagaacuucag

SEQ ID NO: 26442 - RNA, 20 nt, Artificial Sequence
  targeting sequence with TTCN PAM
uuucuauauccaacccuguc

SEQ ID NO: 26443 - RNA, 20 nt, Artificial Sequence
  targeting sequence with TTCN PAM
auauccaacccuguccccau

SEQ ID NO: 26444 - RNA, 20 nt, Artificial Sequence
  targeting sequence with TTCN PAM
ccugccucggccucccaaag

SEQ ID NO: 26445 - RNA, 20 nt, Artificial Sequence
  targeting sequence with TTCN PAM
cgaccagccuggucaacaug

SEQ ID NO: 26446 - RNA, 20 nt, Artificial Sequence
  targeting sequence with TTCN PAM
ccugccucagccucccaagu

SEQ ID NO: 26447 - RNA, 20 nt, Artificial Sequence
  targeting sequence with TTCN PAM
agcgauucuccugccucagc

SEQ ID NO: 26448 - RNA, 20 nt, Artificial Sequence
  targeting sequence with TTCN PAM
gccucccagguucaagcgau

SEQ ID NO: 26449 - RNA, 20 nt, Artificial Sequence
  targeting sequence with TTCN PAM
agcacagagcagauagagag

SEQ ID NO: 26450 - RNA, 20 nt, Artificial Sequence
  targeting sequence with TTCN PAM
cuucaagcacagagcagaua

SEQ ID NO: 26451 - RNA, 20 nt, Artificial Sequence
  targeting sequence with TTCN PAM
uuauuuuccuguuaaaagua

SEQ ID NO: 26452 - RNA, 20 nt, Artificial Sequence
  targeting sequence with TTCN PAM
uguuaaaaguaaucuccuuc

SEQ ID NO: 26453 - RNA, 20 nt, Artificial Sequence
  targeting sequence with TTCN PAM
aguucucuguacuucuaaac

SEQ ID NO: 26454 - RNA, 20 nt, Artificial Sequence
  targeting sequence with TTCN PAM
cuguacuucuaaacuuucua

SEQ ID NO: 26455 - RNA, 20 nt, Artificial Sequence
  targeting sequence with TTCN PAM
aaacuuucuaauuuuuaugg

SEQ ID NO: 26456 - RNA, 20 nt, Artificial Sequence
  targeting sequence with TTCN PAM
aauuuuuaugguauauauau

SEQ ID NO: 26457 - RNA, 20 nt, Artificial Sequence
  targeting sequence with TTCN PAM
ugaacuccuuacagcaccca

SEQ ID NO: 26458 - RNA, 20 nt, Artificial Sequence
  targeting sequence with TTCN PAM
agaauguauaagauauaaga

SEQ ID NO: 26459 - RNA, 20 nt, Artificial Sequence
  targeting sequence with TTCN PAM
guugaggugaccaaucaucu

SEQ ID NO: 26460 - RNA, 20 nt, Artificial Sequence
  targeting sequence with TTCN PAM
cuuuggauuuaguaauuugg

SEQ ID NO: 26461 - RNA, 20 nt, Artificial Sequence
  targeting sequence with TTCN PAM
uaguccucuucuuauugacc

SEQ ID NO: 26462 - RNA, 20 nt, Artificial Sequence
  targeting sequence with TTCN PAM
uauugaccuaucugcagcau

SEQ ID NO: 26463 - RNA, 20 nt, Artificial Sequence
  targeting sequence with TTCN PAM
uuucuccuaugaagaauuuc

SEQ ID NO: 26464 - RNA, 20 nt, Artificial Sequence
  targeting sequence with TTCN PAM
ccuaugaagaauuuccauac

SEQ ID NO: 26465 - RNA, 20 nt, Artificial Sequence
  targeting sequence with TTCN PAM
uaggagaaaggaaacaucaa

SEQ ID NO: 26466 - RNA, 20 nt, Artificial Sequence
  targeting sequence with TTCN PAM
ucauaggagaaaggaaacau

SEQ ID NO: 26467 - RNA, 20 nt, Artificial Sequence
  targeting sequence with TTCN PAM
auacuugguuuuccaguaca

SEQ ID NO: 26468 - RNA, 20 nt, Artificial Sequence
  targeting sequence with TTCN PAM
aguacaccauccucucuaga

SEQ ID NO: 26469 - RNA, 20 nt, Artificial Sequence
  targeting sequence with TTCN PAM
ucuucucucauaggucaauc

SEQ ID NO: 26470 - RNA, 20 nt, Artificial Sequence
  targeting sequence with TTCN PAM
cucauaggucaaucuucuuc

SEQ ID NO: 26471 - RNA, 20 nt, Artificial Sequence
  targeting sequence with TTCN PAM
uccuuuucuucuucucccua

SEQ ID NO: 26472 - RNA, 20 nt, Artificial Sequence
  targeting sequence with TTCN PAM
uuuucuucuucucccuaauu

SEQ ID NO: 26473 - RNA, 20 nt, Artificial Sequence
  targeting sequence with TTCN PAM
ucuucucccuaauuacauuu

SEQ ID NO: 26474 - RNA, 20 nt, Artificial Sequence
  targeting sequence with TTCN PAM
ucucccuaauuacauuuucu

SEQ ID NO: 26475 - RNA, 20 nt, Artificial Sequence
  targeting sequence with TTCN PAM
cccuaauuacauuuucugcc

SEQ ID NO: 26476 - RNA, 20 nt, Artificial Sequence
  targeting sequence with TTCN PAM
gccuagaacuuucuccuuag

SEQ ID NO: 26477 - RNA, 20 nt, Artificial Sequence
  targeting sequence with TTCN PAM
aggcagaaaauguaauuagg

SEQ ID NO: 26478 - RNA, 20 nt, Artificial Sequence
  targeting sequence with TTCN PAM
ccuuaguauccuaugacucu

SEQ ID NO: 26479 - RNA, 20 nt, Artificial Sequence
  targeting sequence with TTCN PAM
acauucccacuuagauggcu

SEQ ID NO: 26480 - RNA, 20 nt, Artificial Sequence
  targeting sequence with TTCN PAM
cacuuagauggcugauggac

SEQ ID NO: 26481 - RNA, 20 nt, Artificial Sequence
  targeting sequence with TTCN PAM
gguguccaucagccaucuaa

SEQ ID NO: 26482 - RNA, 20 nt, Artificial Sequence
  targeting sequence with TTCN PAM
guuucagguguccaucagcc

SEQ ID NO: 26483 - RNA, 20 nt, Artificial Sequence
  targeting sequence with TTCN PAM
cacaaaaccugcccuccagc

SEQ ID NO: 26484 - RNA, 20 nt, Artificial Sequence
  targeting sequence with TTCN PAM
uccagcuguuuagguuaaaa

SEQ ID NO: 26485 - RNA, 20 nt, Artificial Sequence
  targeting sequence with TTCN PAM
agcuguuuagguuaaaaucc

SEQ ID NO: 26486 - RNA, 20 nt, Artificial Sequence
  targeting sequence with TTCN PAM
uucauaccuuacauccaacc

SEQ ID NO: 26487 - RNA, 20 nt, Artificial Sequence
  targeting sequence with TTCN PAM
uaccuuacauccaaccugcc

SEQ ID NO: 26488 - RNA, 20 nt, Artificial Sequence
  targeting sequence with TTCN PAM
ggcagguuggauguaaggua

SEQ ID NO: 26489 - RNA, 20 nt, Artificial Sequence
  targeting sequence with TTCN PAM
guuagcaucgccuucaaaau

SEQ ID NO: 26490 - RNA, 20 nt, Artificial Sequence
  targeting sequence with TTCN PAM
aaauacaucuaaaauccaac

SEQ ID NO: 26491 - RNA, 20 nt, Artificial Sequence
  targeting sequence with TTCN PAM
cuuguacuuuagucugaacc

SEQ ID NO: 26492 - RNA, 20 nt, Artificial Sequence
  targeting sequence with TTCN PAM
gacuaaaguacaagugaaga

SEQ ID NO: 26493 - RNA, 20 nt, Artificial Sequence
  targeting sequence with TTCN PAM
caacuggucuaucuugccca

SEQ ID NO: 26494 - RNA, 20 nt, Artificial Sequence
  targeting sequence with TTCN PAM
uaauacuacaaccagaauga

SEQ ID NO: 26495 - RNA, 20 nt, Artificial Sequence
  targeting sequence with TTCN PAM
gguuguaguauuaagaacag

SEQ ID NO: 26496 - RNA, 20 nt, Artificial Sequence
  targeting sequence with TTCN PAM
ucaaugaauuccugugauac

SEQ ID NO: 26497 - RNA, 20 nt, Artificial Sequence
  targeting sequence with TTCN PAM
augaauuccugugauacuau

SEQ ID NO: 26498 - RNA, 20 nt, Artificial Sequence
  targeting sequence with TTCN PAM
uugaagaauuuuaagcagag

SEQ ID NO: 26499 - RNA, 20 nt, Artificial Sequence
  targeting sequence with TTCN PAM
ugugauacuaugaaauacau

SEQ ID NO: 26500 - RNA, 20 nt, Artificial Sequence
  targeting sequence with TTCN PAM
uaguaucacaggaauucauu

SEQ ID NO: 26501 - RNA, 20 nt, Artificial Sequence
  targeting sequence with TTCN PAM
agggucaacuauguauuuca

SEQ ID NO: 26502 - RNA, 20 nt, Artificial Sequence
  targeting sequence with TTCN PAM
gaccuuuguuguucaagggu

SEQ ID NO: 26503 - RNA, 20 nt, Artificial Sequence
  targeting sequence with TTCN PAM
aauauauuggaaaauauuuu

SEQ ID NO: 26504 - RNA, 20 nt, Artificial Sequence
  targeting sequence with TTCN PAM
aauauauuggaaaaaauaug

SEQ ID NO: 26505 - RNA, 20 nt, Artificial Sequence
  targeting sequence with TTCN PAM
aaucuccaaaauauuuucca

SEQ ID NO: 26506 - RNA, 20 nt, Artificial Sequence
  targeting sequence with TTCN PAM
caaauuguuucaaaucucca

SEQ ID NO: 26507 - RNA, 20 nt, Artificial Sequence
  targeting sequence with TTCN PAM
uagguuaugcaauuugccau

SEQ ID NO: 26508 - RNA, 20 nt, Artificial Sequence
  targeting sequence with TTCN PAM
ugaaugaaugcauaaaacau

SEQ ID NO: 26509 - RNA, 20 nt, Artificial Sequence
  targeting sequence with TTCN PAM
cgaaucuuaauuuuuuggua

SEQ ID NO: 26510 - RNA, 20 nt, Artificial Sequence
  targeting sequence with TTCN PAM
uucacgaaucuuaauuuuuu

SEQ ID NO: 26511 - RNA, 20 nt, Artificial Sequence
  targeting sequence with TTCN PAM
gauuuguacauacuuuaugg

SEQ ID NO: 26512 - RNA, 20 nt, Artificial Sequence
  targeting sequence with TTCN PAM
aucaaaauuuauacaaacac

SEQ ID NO: 26513 - RNA, 20 nt, Artificial Sequence
  targeting sequence with TTCN PAM
cuugacugcaaauggcacca

SEQ ID NO: 26514 - RNA, 20 nt, Artificial Sequence
  targeting sequence with TTCN PAM
cagccaccuccaguugcuag

SEQ ID NO: 26515 - RNA, 20 nt, Artificial Sequence
  targeting sequence with TTCN PAM
cucacugcuagcaacuggag

SEQ ID NO: 26516 - RNA, 20 nt, Artificial Sequence
  targeting sequence with TTCN PAM
ucucuccaguaaacugcaua

SEQ ID NO: 26517 - RNA, 20 nt, Artificial Sequence
  targeting sequence with TTCN PAM
cuauuauuuuucacuguguu

SEQ ID NO: 26518 - RNA, 20 nt, Artificial Sequence
  targeting sequence with TTCN PAM
cuguguuuaguacaauacug

SEQ ID NO: 26519 - RNA, 20 nt, Artificial Sequence
  targeting sequence with TTCN PAM
agguuuacaguauuguacua

SEQ ID NO: 26520 - RNA, 20 nt, Artificial Sequence
  targeting sequence with TTCN PAM
uacgcaucucaugguauuau

SEQ ID NO: 26521 - RNA, 20 nt, Artificial Sequence
  targeting sequence with TTCN PAM
gugucacuagucucacuucu

SEQ ID NO: 26522 - RNA, 20 nt, Artificial Sequence
  targeting sequence with TTCN PAM
ugggagcacuucagugucac

SEQ ID NO: 26523 - RNA, 20 nt, Artificial Sequence
  targeting sequence with TTCN PAM
cugcuucuugggagcacuuc

SEQ ID NO: 26524 - RNA, 20 nt, Artificial Sequence
  targeting sequence with TTCN PAM
uguaaugucaugacauuuuc

SEQ ID NO: 26525 - RNA, 20 nt, Artificial Sequence
  targeting sequence with TTCN PAM
uacagaugauuugucuugua

SEQ ID NO: 26526 - RNA, 20 nt, Artificial Sequence
  targeting sequence with TTCN PAM
cuuccuuaugauuuuaguaa

SEQ ID NO: 26527 - RNA, 20 nt, Artificial Sequence
  targeting sequence with TTCN PAM
uuaugauuuuaguaacauuu

SEQ ID NO: 26528 - RNA, 20 nt, Artificial Sequence
  targeting sequence with TTCN PAM
uuaugauuuucuuaacauuu

SEQ ID NO: 26529 - RNA, 20 nt, Artificial Sequence
  targeting sequence with TTCN PAM
uaacauuuuauuuucucuag

SEQ ID NO: 26530 - RNA, 20 nt, Artificial Sequence
  targeting sequence with TTCN PAM
cuagcuuacuguauuguaag

SEQ ID NO: 26531 - RNA, 20 nt, Artificial Sequence
  targeting sequence with TTCN PAM
uacaauacaguaagcuagag

SEQ ID NO: 26532 - RNA, 20 nt, Artificial Sequence
  targeting sequence with TTCN PAM
gacucccccaaagcuuaacu

SEQ ID NO: 26533 - RNA, 20 nt, Artificial Sequence
  targeting sequence with TTCN PAM
ccuuuuccuggcauacaacu

SEQ ID NO: 26534 - RNA, 20 nt, Artificial Sequence
  targeting sequence with TTCN PAM
uggcauacaacuacuaaaau

SEQ ID NO: 26535 - RNA, 20 nt, Artificial Sequence
  targeting sequence with TTCN PAM
aaggauuuuaguaguuguau

SEQ ID NO: 26536 - RNA, 20 nt, Artificial Sequence
  targeting sequence with TTCN PAM
gggugaggcuggucaucaga

SEQ ID NO: 26537 - RNA, 20 nt, Artificial Sequence
  targeting sequence with TTCN PAM
gaugaccagccucacccuga

SEQ ID NO: 26538 - RNA, 20 nt, Artificial Sequence
  targeting sequence with TTCN PAM
cuaauuaugccuuggucuuu

SEQ ID NO: 26539 - RNA, 20 nt, Artificial Sequence
  targeting sequence with TTCN PAM
gccccaccccccaaccucug

SEQ ID NO: 26540 - RNA, 20 nt, Artificial Sequence
  targeting sequence with TTCN PAM
uuuacccucccagagguugg

SEQ ID NO: 26541 - RNA, 20 nt, Artificial Sequence
  targeting sequence with TTCN PAM
cucuccuuccuuuacccucc

SEQ ID NO: 26542 - RNA, 20 nt, Artificial Sequence
  targeting sequence with TTCN PAM
uuaugugggugugauugauu

SEQ ID NO: 26543 - RNA, 20 nt, Artificial Sequence
  targeting sequence with TTCN PAM
auaaaaacccaaaaggacag

SEQ ID NO: 26544 - RNA, 20 nt, Artificial Sequence
  targeting sequence with TTCN PAM
ggauagcugaacauguggag

SEQ ID NO: 26545 - RNA, 20 nt, Artificial Sequence
  targeting sequence with TTCN PAM
gcuauccagaagcucccuaa

SEQ ID NO: 26546 - RNA, 20 nt, Artificial Sequence
  targeting sequence with TTCN PAM
uggagggugggggcuuaaug

SEQ ID NO: 26547 - RNA, 20 nt, Artificial Sequence
  targeting sequence with TTCN PAM
auuaagcccccacccuccag

SEQ ID NO: 26548 - RNA, 20 nt, Artificial Sequence
  targeting sequence with TTCN PAM
cauaugccuugccuaugcau

SEQ ID NO: 26549 - RNA, 20 nt, Artificial Sequence
  targeting sequence with TTCN PAM
ucugcauccuuuauaauagg

SEQ ID NO: 26550 - RNA, 20 nt, Artificial Sequence
  targeting sequence with TTCN PAM
ugaauucuguaagccacucu

SEQ ID NO: 26551 - RNA, 20 nt, Artificial Sequence
  targeting sequence with TTCN PAM
agaaaacguguauacuggcc

SEQ ID NO: 26552 - RNA, 20 nt, Artificial Sequence
  targeting sequence with TTCN PAM
guaagccacucuagcaaauu

SEQ ID NO: 26553 - RNA, 20 nt, Artificial Sequence
  targeting sequence with TTCN PAM
guuaauuugcuagaguggcu

SEQ ID NO: 26554 - RNA, 20 nt, Artificial Sequence
  targeting sequence with TTCN PAM
acagcccccuccuuggauuc

SEQ ID NO: 26555 - RNA, 20 nt, Artificial Sequence
  targeting sequence with TTCN PAM
gaccaacuggcuguaaauug

SEQ ID NO: 26556 - RNA, 20 nt, Artificial Sequence
  targeting sequence with TTCN PAM
augggcauuggaaaugggau

SEQ ID NO: 26557 - RNA, 20 nt, Artificial Sequence
  targeting sequence with TTCN PAM
aaugcccauugaaagcccca

SEQ ID NO: 26558 - RNA, 20 nt, Artificial Sequence
  targeting sequence with TTCN PAM
gacucugucuaccuggagau

SEQ ID NO: 26559 - RNA, 20 nt, Artificial Sequence
  targeting sequence with TTCN PAM
auucugacucugucuaccug

SEQ ID NO: 26560 - RNA, 20 nt, Artificial Sequence
  targeting sequence with TTCN PAM
auucaauucugacucugucu

SEQ ID NO: 26561 - RNA, 20 nt, Artificial Sequence
  targeting sequence with TTCN PAM
gcagcagacaccagcugggu

SEQ ID NO: 26562 - RNA, 20 nt, Artificial Sequence
  targeting sequence with TTCN PAM
caccagcaagcaauucugca

SEQ ID NO: 26563 - RNA, 20 nt, Artificial Sequence
  targeting sequence with TTCN PAM
ucccaccagcaagcaauucu

SEQ ID NO: 26564 - RNA, 20 nt, Artificial Sequence
  targeting sequence with TTCN PAM
gaugccaggucuguggagau

SEQ ID NO: 26565 - RNA, 20 nt, Artificial Sequence
  targeting sequence with TTCN PAM
cccacuauccucucaacaac

SEQ ID NO: 26566 - RNA, 20 nt, Artificial Sequence
  targeting sequence with TTCN PAM
uuuacacucaaauggccuuc

SEQ ID NO: 26567 - RNA, 20 nt, Artificial Sequence
  targeting sequence with TTCN PAM
aaggcacaucugauuuggcc

SEQ ID NO: 26568 - RNA, 20 nt, Artificial Sequence
  targeting sequence with TTCN PAM
uuaugguagauuaauagcca

SEQ ID NO: 26569 - RNA, 20 nt, Artificial Sequence
  targeting sequence with TTCN PAM
uccaaucucguauacccuuc

SEQ ID NO: 26570 - RNA, 20 nt, Artificial Sequence
  targeting sequence with TTCN PAM
cuuuauaauuuggauuuccc

SEQ ID NO: 26571 - RNA, 20 nt, Artificial Sequence
  targeting sequence with TTCN PAM
cacuccugucaagagguggc

SEQ ID NO: 26572 - RNA, 20 nt, Artificial Sequence
  targeting sequence with TTCN PAM
ggccaggcacggugucucau

SEQ ID NO: 26573 - RNA, 20 nt, Artificial Sequence
  targeting sequence with TTCN PAM
uuuagggcucuccuaugaau

SEQ ID NO: 26574 - RNA, 20 nt, Artificial Sequence
  targeting sequence with TTCN PAM
uaggagagcccuaaaggaau

SEQ ID NO: 26575 - RNA, 20 nt, Artificial Sequence
  targeting sequence with TTCN PAM
uucugaucaccccacucacc

SEQ ID NO: 26576 - RNA, 20 nt, Artificial Sequence
  targeting sequence with TTCN PAM
gaucaccccacucacccugg

SEQ ID NO: 26577 - RNA, 20 nt, Artificial Sequence
  targeting sequence with TTCN PAM
uaauaaaauagauaaguaaa

SEQ ID NO: 26578 - RNA, 20 nt, Artificial Sequence
  targeting sequence with TTCN PAM
gagguuauaaaaggucaguu

SEQ ID NO: 26579 - RNA, 20 nt, Artificial Sequence
  targeting sequence with TTCN PAM
aaaccccugacacaucucug

SEQ ID NO: 26580 - RNA, 20 nt, Artificial Sequence
  targeting sequence with TTCN PAM
guuguuugcuauauaucuug

SEQ ID NO: 26581 - RNA, 20 nt, Artificial Sequence
  targeting sequence with TTCN PAM
auaucaaacuucacagugaa

SEQ ID NO: 26582 - RNA, 20 nt, Artificial Sequence
  targeting sequence with TTCN PAM
cagugaaaaaucuguuugga

SEQ ID NO: 26583 - RNA, 20 nt, Artificial Sequence
  targeting sequence with TTCN PAM
cugugaaguuugauauugaa

SEQ ID NO: 26584 - RNA, 20 nt, Artificial Sequence
  targeting sequence with TTCN PAM
uauuguuugcuauugagcag

SEQ ID NO: 26585 - RNA, 20 nt, Artificial Sequence
  targeting sequence with TTCN PAM
gaaucaggcaaaacuauaaa

SEQ ID NO: 26586 - RNA, 20 nt, Artificial Sequence
  targeting sequence with TTCN PAM
gaaguuaauguacauucaua

SEQ ID NO: 26587 - RNA, 20 nt, Artificial Sequence
  targeting sequence with TTCN PAM
uuauaguuuugccugauucu

SEQ ID NO: 26588 - RNA, 20 nt, Artificial Sequence
  targeting sequence with TTCN PAM
aagagauaaauacuaaagca

SEQ ID NO: 26589 - RNA, 20 nt, Artificial Sequence
  targeting sequence with TTCN PAM
uccauaguccugaguacaaa

SEQ ID NO: 26590 - RNA, 20 nt, Artificial Sequence
  targeting sequence with TTCN PAM
cauuucauccauaguccuga

SEQ ID NO: 26591 - RNA, 20 nt, Artificial Sequence
  targeting sequence with TTCN PAM
acacaaccaccauuuucaca

SEQ ID NO: 26592 - RNA, 20 nt, Artificial Sequence
  targeting sequence with TTCN PAM
gcugaucuggagauacaagu

SEQ ID NO: 26593 - RNA, 20 nt, Artificial Sequence
  targeting sequence with TTCN PAM
cacugagauauguguauauu

SEQ ID NO: 26594 - RNA, 20 nt, Artificial Sequence
  targeting sequence with TTCN PAM
gaaaauuuccaaguccuugg

SEQ ID NO: 26595 - RNA, 20 nt, Artificial Sequence
  targeting sequence with TTCN PAM
gaauuguaaagcaauauaca

SEQ ID NO: 26596 - RNA, 20 nt, Artificial Sequence
  targeting sequence with TTCN PAM
aaguccuugggaaaaauacu

SEQ ID NO: 26597 - RNA, 20 nt, Artificial Sequence
  targeting sequence with TTCN PAM
caaggacuuggaaauuuucu

SEQ ID NO: 26598 - RNA, 20 nt, Artificial Sequence
  targeting sequence with TTCN PAM
aaguauuuuucccaaggacu

SEQ ID NO: 26599 - RNA, 20 nt, Artificial Sequence
  targeting sequence with TTCN PAM
uagugcucagcuacuuauuu

SEQ ID NO: 26600 - RNA, 20 nt, Artificial Sequence
  targeting sequence with TTCN PAM
uuuuuuuuuuuuuuuuuugg

SEQ ID NO: 26601 - RNA, 20 nt, Artificial Sequence
  targeting sequence with TTCN PAM
ugauggaucuagguggccaa

SEQ ID NO: 26602 - RNA, 20 nt, Artificial Sequence
  targeting sequence with TTCN PAM
agguggcucuaaaucaaauu

SEQ ID NO: 26603 - RNA, 20 nt, Artificial Sequence
  targeting sequence with TTCN PAM
uauuuguuaugcaugccugg

SEQ ID NO: 26604 - RNA, 20 nt, Artificial Sequence
  targeting sequence with TTCN PAM
aauuuaacccauguuuuucc

SEQ ID NO: 26605 - RNA, 20 nt, Artificial Sequence
  targeting sequence with TTCN PAM
aagaugccaggcaugcauaa

SEQ ID NO: 26606 - RNA, 20 nt, Artificial Sequence
  targeting sequence with TTCN PAM
caagcaguccaaggcaaaug

SEQ ID NO: 26607 - RNA, 20 nt, Artificial Sequence
  targeting sequence with TTCN PAM
uuugccuuggacugcuuggg

SEQ ID NO: 26608 - RNA, 20 nt, Artificial Sequence
  targeting sequence with TTCN PAM
uugaaagaaacacugauuuu

SEQ ID NO: 26609 - RNA, 20 nt, Artificial Sequence
  targeting sequence with TTCN PAM
augaacaagaguuucauuug

SEQ ID NO: 26610 - RNA, 20 nt, Artificial Sequence
  targeting sequence with TTCN PAM
uucaaugaacaagaguuuca

SEQ ID NO: 26611 - RNA, 20 nt, Artificial Sequence
  targeting sequence with TTCN PAM
aguaacuauuucgcuugaga

SEQ ID NO: 26612 - RNA, 20 nt, Artificial Sequence
  targeting sequence with TTCN PAM
cuugagaaagugaggaugac

SEQ ID NO: 26613 - RNA, 20 nt, Artificial Sequence
  targeting sequence with TTCN PAM
caagcgaaauaguuacugga

SEQ ID NO: 26614 - RNA, 20 nt, Artificial Sequence
  targeting sequence with TTCN PAM
uugcagaguaagugucaucc

SEQ ID NO: 26615 - RNA, 20 nt, Artificial Sequence
  targeting sequence with TTCN PAM
guccaaauagcuuuggguaa

SEQ ID NO: 26616 - RNA, 20 nt, Artificial Sequence
  targeting sequence with TTCN PAM
uuuuacccaaagcuauuugg

SEQ ID NO: 26617 - RNA, 20 nt, Artificial Sequence
  targeting sequence with TTCN PAM
uaguuguucauuuuacccaa

SEQ ID NO: 26618 - RNA, 20 nt, Artificial Sequence
  targeting sequence with TTCN PAM
ccauuauuacaaccuuacac

SEQ ID NO: 26619 - RNA, 20 nt, Artificial Sequence
  targeting sequence with TTCN PAM
gcaguagaucucagccaggg

SEQ ID NO: 26620 - RNA, 20 nt, Artificial Sequence
  targeting sequence with TTCN PAM
gcagcucaggcuauuuccuu

SEQ ID NO: 26621 - RNA, 20 nt, Artificial Sequence
  targeting sequence with TTCN PAM
uuugucugucuauucaacca

SEQ ID NO: 26622 - RNA, 20 nt, Artificial Sequence
  targeting sequence with TTCN PAM
accagcccccacuuaaagcu

SEQ ID NO: 26623 - RNA, 20 nt, Artificial Sequence
  targeting sequence with TTCN PAM
ggaugagauuuuuuuuuuuu

SEQ ID NO: 26624 - RNA, 20 nt, Artificial Sequence
  targeting sequence with TTCN PAM
gaggagagugagggcuccau

SEQ ID NO: 26625 - RNA, 20 nt, Artificial Sequence
  targeting sequence with TTCN PAM
uccuccuccucucucacaag

SEQ ID NO: 26626 - RNA, 20 nt, Artificial Sequence
  targeting sequence with TTCN PAM
gcauauuccuccuccuccuc

SEQ ID NO: 26627 - RNA, 20 nt, Artificial Sequence
  targeting sequence with TTCN PAM
cccagauuugaacauguugu

SEQ ID NO: 26628 - RNA, 20 nt, Artificial Sequence
  targeting sequence with TTCN PAM
aaucugggagaaaccugagg

SEQ ID NO: 26629 - RNA, 20 nt, Artificial Sequence
  targeting sequence with TTCN PAM
gccucacagggcuggaguaa

SEQ ID NO: 26630 - RNA, 20 nt, Artificial Sequence
  targeting sequence with TTCN PAM
acccugacaaagcaguauca

SEQ ID NO: 26631 - RNA, 20 nt, Artificial Sequence
  targeting sequence with TTCN PAM
uauuacagugauacugcuuu

SEQ ID NO: 26632 - RNA, 20 nt, Artificial Sequence
  targeting sequence with TTCN PAM
gggcauguuggcagcuguac

SEQ ID NO: 26633 - RNA, 20 nt, Artificial Sequence
  targeting sequence with TTCN PAM
guacagcugccaacaugccc

SEQ ID NO: 26634 - RNA, 20 nt, Artificial Sequence
  targeting sequence with TTCN PAM
agaaaguaauggcaauucca

SEQ ID NO: 26635 - RNA, 20 nt, Artificial Sequence
  targeting sequence with TTCN PAM
agaacaggcauucuguacag

SEQ ID NO: 26636 - RNA, 20 nt, Artificial Sequence
  targeting sequence with TTCN PAM
aaaacaagagaucuauggug

SEQ ID NO: 26637 - RNA, 20 nt, Artificial Sequence
  targeting sequence with TTCN PAM
gcccaguuaagcaauaagca

SEQ ID NO: 26638 - RNA, 20 nt, Artificial Sequence
  targeting sequence with TTCN PAM
aaguauuuugggugcuuauu

SEQ ID NO: 26639 - RNA, 20 nt, Artificial Sequence
  targeting sequence with TTCN PAM
accauuaaacuuuugagcug

SEQ ID NO: 26640 - RNA, 20 nt, Artificial Sequence
  targeting sequence with TTCN PAM
uuucuaccauuaaacuuuug

SEQ ID NO: 26641 - RNA, 20 nt, Artificial Sequence
  targeting sequence with TTCN PAM
ccuugacccuauuuuguguc

SEQ ID NO: 26642 - RNA, 20 nt, Artificial Sequence
  targeting sequence with TTCN PAM
uccagacacaaaauaggguc

SEQ ID NO: 26643 - RNA, 20 nt, Artificial Sequence
  targeting sequence with TTCN PAM
ugauuauuuccuccagacac

SEQ ID NO: 26644 - RNA, 20 nt, Artificial Sequence
  targeting sequence with TTCN PAM
uccugauuauuuccuccaga

SEQ ID NO: 26645 - RNA, 20 nt, Artificial Sequence
  targeting sequence with TTCN PAM
ucuuccugauuauuuccucc

SEQ ID NO: 26646 - RNA, 20 nt, Artificial Sequence
  targeting sequence with TTCN PAM
aguuuucuucuuccugauua

SEQ ID NO: 26647 - RNA, 20 nt, Artificial Sequence
  targeting sequence with TTCN PAM
uccaguuuucuucuuccuga

SEQ ID NO: 26648 - RNA, 20 nt, Artificial Sequence
  targeting sequence with TTCN PAM
gaucugaucuguuccugggc

SEQ ID NO: 26649 - RNA, 20 nt, Artificial Sequence
  targeting sequence with TTCN PAM
ugggcacuacgaccuagcug

SEQ ID NO: 26650 - RNA, 20 nt, Artificial Sequence
  targeting sequence with TTCN PAM
gcuaggucguagugcccagg

SEQ ID NO: 26651 - RNA, 20 nt, Artificial Sequence
  targeting sequence with TTCN PAM
ucagcuaggucguagugccc

SEQ ID NO: 26652 - RNA, 20 nt, Artificial Sequence
  targeting sequence with TTCN PAM
auaguaaagucacagaggug

SEQ ID NO: 26653 - RNA, 20 nt, Artificial Sequence
  targeting sequence with TTCN PAM
cccuguuccauaguaaaguc

SEQ ID NO: 26654 - RNA, 20 nt, Artificial Sequence
  targeting sequence with TTCN PAM
ggaaauacauuuuugguaau

SEQ ID NO: 26655 - RNA, 20 nt, Artificial Sequence
  targeting sequence with TTCN PAM
agaauauucucccuguucca

SEQ ID NO: 26656 - RNA, 20 nt, Artificial Sequence
  targeting sequence with TTCN PAM
ggcauauauccauuaccaaa

SEQ ID NO: 26657 - RNA, 20 nt, Artificial Sequence
  targeting sequence with TTCN PAM
guucuggcauauauccauua

SEQ ID NO: 26658 - RNA, 20 nt, Artificial Sequence
  targeting sequence with TTCN PAM
caccuucaguucuggcauau

SEQ ID NO: 26659 - RNA, 20 nt, Artificial Sequence
  targeting sequence with TTCN PAM
uaugugcccaaaaggcaaac

SEQ ID NO: 26660 - RNA, 20 nt, Artificial Sequence
  targeting sequence with TTCN PAM
uuuuaguucaagaaugugug

SEQ ID NO: 26661 - RNA, 20 nt, Artificial Sequence
  targeting sequence with TTCN PAM
agaaugugugccuuuagaaa

SEQ ID NO: 26662 - RNA, 20 nt, Artificial Sequence
  targeting sequence with TTCN PAM
ugaacuaaaaagaaaugaug

SEQ ID NO: 26663 - RNA, 20 nt, Artificial Sequence
  targeting sequence with TTCN PAM
aaaggcacacauucuugaac

SEQ ID NO: 26664 - RNA, 20 nt, Artificial Sequence
  targeting sequence with TTCN PAM
uccuccaaagaagaggggca

SEQ ID NO: 26665 - RNA, 20 nt, Artificial Sequence
  targeting sequence with TTCN PAM
uccaaagaagaggggcacua

SEQ ID NO: 26666 - RNA, 20 nt, Artificial Sequence
  targeting sequence with TTCN PAM
uuggaggaagaauuucuaaa

SEQ ID NO: 26667 - RNA, 20 nt, Artificial Sequence
  targeting sequence with TTCN PAM
ggcuccuuuuuuagugcccc

SEQ ID NO: 26668 - RNA, 20 nt, Artificial Sequence
  targeting sequence with TTCN PAM
uguucuggcuccuuuuuuag

SEQ ID NO: 26669 - RNA, 20 nt, Artificial Sequence
  targeting sequence with TTCN PAM
accaagagaaaacagggcaa

SEQ ID NO: 26670 - RNA, 20 nt, Artificial Sequence
  targeting sequence with TTCN PAM
cuugguagaaaauucauguu

SEQ ID NO: 26671 - RNA, 20 nt, Artificial Sequence
  targeting sequence with TTCN PAM
uuuacauuuuaugguguccc

SEQ ID NO: 26672 - RNA, 20 nt, Artificial Sequence
  targeting sequence with TTCN PAM
uaguauaagggacaccauaa

SEQ ID NO: 26673 - RNA, 20 nt, Artificial Sequence
  targeting sequence with TTCN PAM
auucuagaccaaaagugacc

SEQ ID NO: 26674 - RNA, 20 nt, Artificial Sequence
  targeting sequence with TTCN PAM
agaccaaaagugacccaaua

SEQ ID NO: 26675 - RNA, 20 nt, Artificial Sequence
  targeting sequence with TTCN PAM
uggcuaaauuuuacuuguua

SEQ ID NO: 26676 - RNA, 20 nt, Artificial Sequence
  targeting sequence with TTCN PAM
uuuaucuccauugucuugug

SEQ ID NO: 26677 - RNA, 20 nt, Artificial Sequence
  targeting sequence with TTCN PAM
cauuagugcuguaguacagu

SEQ ID NO: 26678 - RNA, 20 nt, Artificial Sequence
  targeting sequence with TTCN PAM
uauagauuuaccuucccauu

SEQ ID NO: 26679 - RNA, 20 nt, Artificial Sequence
  targeting sequence with TTCN PAM
ucaauaguucagugggauaa

SEQ ID NO: 26680 - RNA, 20 nt, Artificial Sequence
  targeting sequence with TTCN PAM
auaguucagugggauaagga

SEQ ID NO: 26681 - RNA, 20 nt, Artificial Sequence
  targeting sequence with TTCN PAM
gugggauaaggagggauaag

SEQ ID NO: 26682 - RNA, 20 nt, Artificial Sequence
  targeting sequence with TTCN PAM
uuaucccuccuuaucccacu

SEQ ID NO: 26683 - RNA, 20 nt, Artificial Sequence
  targeting sequence with TTCN PAM
uuauuccuuaucccuccuua

SEQ ID NO: 26684 - RNA, 20 nt, Artificial Sequence
  targeting sequence with TTCN PAM
agauacacuagcuuuguuuu

SEQ ID NO: 26685 - RNA, 20 nt, Artificial Sequence
  targeting sequence with TTCN PAM
aaauuaccugcuuugaaaca

SEQ ID NO: 26686 - RNA, 20 nt, Artificial Sequence
  targeting sequence with TTCN PAM
uguauuaauaaacuuuucuu

SEQ ID NO: 26687 - RNA, 20 nt, Artificial Sequence
  targeting sequence with TTCN PAM
uuaggucauuuuauaagaac

SEQ ID NO: 26688 - RNA, 20 nt, Artificial Sequence
  targeting sequence with TTCN PAM
uauaaaaugaccuaaagaaa

SEQ ID NO: 26689 - RNA, 20 nt, Artificial Sequence
  targeting sequence with TTCN PAM
gagguucuuauaaaaugacc

SEQ ID NO: 26690 - RNA, 20 nt, Artificial Sequence
  targeting sequence with TTCN PAM
aaguagauuacucuuucaga

SEQ ID NO: 26691 - RNA, 20 nt, Artificial Sequence
  targeting sequence with TTCN PAM
uuugauaguguaaguauaac

SEQ ID NO: 26692 - RNA, 20 nt, Artificial Sequence
  targeting sequence with TTCN PAM
cuaguuuuaagaugcacaag

SEQ ID NO: 26693 - RNA, 20 nt, Artificial Sequence
  targeting sequence with TTCN PAM
ugugcaucuuaaaacuaggg

SEQ ID NO: 26694 - RNA, 20 nt, Artificial Sequence
  targeting sequence with TTCN PAM
gggcacuguuucuugugcau

SEQ ID NO: 26695 - RNA, 20 nt, Artificial Sequence
  targeting sequence with TTCN PAM
auugguaauaaccaccauuc

SEQ ID NO: 26696 - RNA, 20 nt, Artificial Sequence
  targeting sequence with TTCN PAM
uuucaauugguaauaaccac

SEQ ID NO: 26697 - RNA, 20 nt, Artificial Sequence
  targeting sequence with TTCN PAM
gagcuucuuucuuagcaaua

SEQ ID NO: 26698 - RNA, 20 nt, Artificial Sequence
  targeting sequence with TTCN PAM
uucuuagcaauaucuuaaca

SEQ ID NO: 26699 - RNA, 20 nt, Artificial Sequence
  targeting sequence with TTCN PAM
agaucugauagggccacaac

SEQ ID NO: 26700 - RNA, 20 nt, Artificial Sequence
  targeting sequence with TTCN PAM
ccauuucuguucuuucuacu

SEQ ID NO: 26701 - RNA, 20 nt, Artificial Sequence
  targeting sequence with TTCN PAM
guucuuucuacuaaaccaug

SEQ ID NO: 26702 - RNA, 20 nt, Artificial Sequence
  targeting sequence with TTCN PAM
uucuacuaaaccauggugua

SEQ ID NO: 26703 - RNA, 20 nt, Artificial Sequence
  targeting sequence with TTCN PAM
acuaaaccaugguguacccu

SEQ ID NO: 26704 - RNA, 20 nt, Artificial Sequence
  targeting sequence with TTCN PAM
uacuucaugcacugucauac

SEQ ID NO: 26705 - RNA, 20 nt, Artificial Sequence
  targeting sequence with TTCN PAM
ugcacugucauaccaaucug

SEQ ID NO: 26706 - RNA, 20 nt, Artificial Sequence
  targeting sequence with TTCN PAM
uacaauggugacauaaaaaa

SEQ ID NO: 26707 - RNA, 20 nt, Artificial Sequence
  targeting sequence with TTCN PAM
auuguuuucauacaauggug

SEQ ID NO: 26708 - RNA, 20 nt, Artificial Sequence
  targeting sequence with TTCN PAM
uuuguuuguuccauuguuuu

SEQ ID NO: 26709 - RNA, 20 nt, Artificial Sequence
  targeting sequence with TTCN PAM
auuucugcaauguacucacu

SEQ ID NO: 26710 - RNA, 20 nt, Artificial Sequence
  targeting sequence with TTCN PAM
gcaauguacucacuuugcag

SEQ ID NO: 26711 - RNA, 20 nt, Artificial Sequence
  targeting sequence with TTCN PAM
ugguuugguauuccugccuu

SEQ ID NO: 26712 - RNA, 20 nt, Artificial Sequence
  targeting sequence with TTCN PAM
ugccuuauagcuucacuaua

SEQ ID NO: 26713 - RNA, 20 nt, Artificial Sequence
  targeting sequence with TTCN PAM
uuugguaacuaaaaagauau

SEQ ID NO: 26714 - RNA, 20 nt, Artificial Sequence
  targeting sequence with TTCN PAM
uaccuaggacucuccagacu

SEQ ID NO: 26715 - RNA, 20 nt, Artificial Sequence
  targeting sequence with TTCN PAM
guuaacuuacuguuuuucau

SEQ ID NO: 26716 - RNA, 20 nt, Artificial Sequence
  targeting sequence with TTCN PAM
cuccucuccugguagacaug

SEQ ID NO: 26717 - RNA, 20 nt, Artificial Sequence
  targeting sequence with TTCN PAM
aucauagcagagcugguagg

SEQ ID NO: 26718 - RNA, 20 nt, Artificial Sequence
  targeting sequence with TTCN PAM
uccacaacugaugcaccuac

SEQ ID NO: 26719 - RNA, 20 nt, Artificial Sequence
  targeting sequence with TTCN PAM
uguugauuuggggacuuccc

SEQ ID NO: 26720 - RNA, 20 nt, Artificial Sequence
  targeting sequence with TTCN PAM
cuuuggggccucuggcuugc

SEQ ID NO: 26721 - RNA, 20 nt, Artificial Sequence
  targeting sequence with TTCN PAM
ucuuggguggcacucgaauc

SEQ ID NO: 26722 - RNA, 20 nt, Artificial Sequence
  targeting sequence with TTCN PAM
agugccacccaagaugaaga

SEQ ID NO: 26723 - RNA, 20 nt, Artificial Sequence
  targeting sequence with TTCN PAM
gagcuguggggugggugggg

SEQ ID NO: 26724 - RNA, 20 nt, Artificial Sequence
  targeting sequence with TTCN PAM
ggcuuuccagauccauuuca

SEQ ID NO: 26725 - RNA, 20 nt, Artificial Sequence
  targeting sequence with TTCN PAM
agauccauuucagguucugg

SEQ ID NO: 26726 - RNA, 20 nt, Artificial Sequence
  targeting sequence with TTCN PAM
gguucuggaucugccugaau

SEQ ID NO: 26727 - RNA, 20 nt, Artificial Sequence
  targeting sequence with TTCN PAM
ggaucugccugaauuugcug

SEQ ID NO: 26728 - RNA, 20 nt, Artificial Sequence
  targeting sequence with TTCN PAM
ggcagauccagaaccugaaa

SEQ ID NO: 26729 - RNA, 20 nt, Artificial Sequence
  targeting sequence with TTCN PAM
agcaccagcgcaggagguca

SEQ ID NO: 26730 - RNA, 20 nt, Artificial Sequence
  targeting sequence with TTCN PAM
agccuuggccaaucacguua

SEQ ID NO: 26731 - RNA, 20 nt, Artificial Sequence
  targeting sequence with TTCN PAM
ccaaagcauugugggucauu

SEQ ID NO: 26732 - RNA, 20 nt, Artificial Sequence
  targeting sequence with TTCN PAM
gauucugucugcuuucuggc

SEQ ID NO: 26733 - RNA, 20 nt, Artificial Sequence
  targeting sequence with TTCN PAM
gucugcuuucuggccucugc

SEQ ID NO: 26734 - RNA, 20 nt, Artificial Sequence
  targeting sequence with TTCN PAM
ggccucugcaucuugggauu

SEQ ID NO: 26735 - RNA, 20 nt, Artificial Sequence
  targeting sequence with TTCN PAM
cugcccgaaggcuccaucag

SEQ ID NO: 26736 - RNA, 20 nt, Artificial Sequence
  targeting sequence with TTCN PAM
ggcagugaacaguuauuuga

SEQ ID NO: 26737 - RNA, 20 nt, Artificial Sequence
  targeting sequence with TTCN PAM
acagugacuacgcaugcagc

SEQ ID NO: 26738 - RNA, 20 nt, Artificial Sequence
  targeting sequence with TTCN PAM
ucucacagcugcaugcguag

SEQ ID NO: 26739 - RNA, 20 nt, Artificial Sequence
  targeting sequence with TTCN PAM
ugccuaucuaauguuaaaaa

SEQ ID NO: 26740 - RNA, 20 nt, Artificial Sequence
  targeting sequence with TTCN PAM
uaaccacaguuaauuauuca

SEQ ID NO: 26741 - RNA, 20 nt, Artificial Sequence
  targeting sequence with TTCN PAM
caggcugaaacucaguauaa

SEQ ID NO: 26742 - RNA, 20 nt, Artificial Sequence
  targeting sequence with TTCN PAM
gccugugaauaauuaacugu

SEQ ID NO: 26743 - RNA, 20 nt, Artificial Sequence
  targeting sequence with TTCN PAM
uugauuauacugaguuucag

SEQ ID NO: 26744 - RNA, 20 nt, Artificial Sequence
  targeting sequence with TTCN PAM
cacuguuguucuuugauuau

SEQ ID NO: 26745 - RNA, 20 nt, Artificial Sequence
  targeting sequence with TTCN PAM
auuaaaauccacauauaguu

SEQ ID NO: 26746 - RNA, 20 nt, Artificial Sequence
  targeting sequence with TTCN PAM
uauucaucaaguucacuggu

SEQ ID NO: 26747 - RNA, 20 nt, Artificial Sequence
  targeting sequence with TTCN PAM
ucaaguucacugguaacuag

SEQ ID NO: 26748 - RNA, 20 nt, Artificial Sequence
  targeting sequence with TTCN PAM
cugguaacuagagaugacag

SEQ ID NO: 26749 - RNA, 20 nt, Artificial Sequence
  targeting sequence with TTCN PAM
caaaagagcaaaccugucau

SEQ ID NO: 26750 - RNA, 20 nt, Artificial Sequence
  targeting sequence with TTCN PAM
cuucucaaaagagcaaaccu

SEQ ID NO: 26751 - RNA, 20 nt, Artificial Sequence
  targeting sequence with TTCN PAM
auucucuucucaaaagagca

SEQ ID NO: 26752 - RNA, 20 nt, Artificial Sequence
  targeting sequence with TTCN PAM
acuuacaggauuuuuauuuc

SEQ ID NO: 26753 - RNA, 20 nt, Artificial Sequence
  targeting sequence with TTCN PAM
cugcugaagcacaaaugacc

SEQ ID NO: 26754 - RNA, 20 nt, Artificial Sequence
  targeting sequence with TTCN PAM
gcagagaauucaacuuacag

SEQ ID NO: 26755 - RNA, 20 nt, Artificial Sequence
  targeting sequence with TTCN PAM
ggcaccauaugagugaaugg

SEQ ID NO: 26756 - RNA, 20 nt, Artificial Sequence
  targeting sequence with TTCN PAM
cucauauggugccagaaagg

SEQ ID NO: 26757 - RNA, 20 nt, Artificial Sequence
  targeting sequence with TTCN PAM
gacagaaucagaaucagaga

SEQ ID NO: 26758 - RNA, 20 nt, Artificial Sequence
  targeting sequence with TTCN PAM
gucugaaccauucacucaua

SEQ ID NO: 26759 - RNA, 20 nt, Artificial Sequence
  targeting sequence with TTCN PAM
gauucugucugaaccauuca

SEQ ID NO: 26760 - RNA, 20 nt, Artificial Sequence
  targeting sequence with TTCN PAM
ugauagcugguacugagcaa

SEQ ID NO: 26761 - RNA, 20 nt, Artificial Sequence
  targeting sequence with TTCN PAM
aagaaaucccuuucucuaua

SEQ ID NO: 26762 - RNA, 20 nt, Artificial Sequence
  targeting sequence with TTCN PAM
uugaaucuccuuucuugaua

SEQ ID NO: 26763 - RNA, 20 nt, Artificial Sequence
  targeting sequence with TTCN PAM
cuauagugucaucccugaca

SEQ ID NO: 26764 - RNA, 20 nt, Artificial Sequence
  targeting sequence with TTCN PAM
gucagggaugacacuauaga

SEQ ID NO: 26765 - RNA, 20 nt, Artificial Sequence
  targeting sequence with TTCN PAM
cauauauccauacaaacuca

SEQ ID NO: 26766 - RNA, 20 nt, Artificial Sequence
  targeting sequence with TTCN PAM
auccuacccaguuacuuugc

SEQ ID NO: 26767 - RNA, 20 nt, Artificial Sequence
  targeting sequence with TTCN PAM
cuacuuuucuauccuaccca

SEQ ID NO: 26768 - RNA, 20 nt, Artificial Sequence
  targeting sequence with TTCN PAM
uuuucucuacuuuucuaucc

SEQ ID NO: 26769 - RNA, 20 nt, Artificial Sequence
  targeting sequence with TTCN PAM
ugcauuuaauacugguauau

SEQ ID NO: 26770 - RNA, 20 nt, Artificial Sequence
  targeting sequence with TTCN PAM
uuuuaauuucuugcauuuaa

SEQ ID NO: 26771 - RNA, 20 nt, Artificial Sequence
  targeting sequence with TTCN PAM
gcuuccuuuuaauuucuugc

SEQ ID NO: 26772 - RNA, 20 nt, Artificial Sequence
  targeting sequence with TTCN PAM
uaauagaaaguguuuauuuu

SEQ ID NO: 26773 - RNA, 20 nt, Artificial Sequence
  targeting sequence with TTCN PAM
auuaggaaaaaucucaucau

SEQ ID NO: 26774 - RNA, 20 nt, Artificial Sequence
  targeting sequence with TTCN PAM
gugcauguauauaauuuugu

SEQ ID NO: 26775 - RNA, 20 nt, Artificial Sequence
  targeting sequence with TTCN PAM
guagcagcuucugugcaugu

SEQ ID NO: 26776 - RNA, 20 nt, Artificial Sequence
  targeting sequence with TTCN PAM
auauuuuucuuuaaauuuuu

SEQ ID NO: 26777 - RNA, 20 nt, Artificial Sequence
  targeting sequence with TTCN PAM
uuaaauuuuuguuuaaagga

SEQ ID NO: 26778 - RNA, 20 nt, Artificial Sequence
  targeting sequence with TTCN PAM
acaauuuaagccacuaccaa

SEQ ID NO: 26779 - RNA, 20 nt, Artificial Sequence
  targeting sequence with TTCN PAM
uugguaguggcuuaaauugu

SEQ ID NO: 26780 - RNA, 20 nt, Artificial Sequence
  targeting sequence with TTCN PAM
gggaauauguggacuugcug

SEQ ID NO: 26781 - RNA, 20 nt, Artificial Sequence
  targeting sequence with TTCN PAM
cagaacaggagcaccauggu

SEQ ID NO: 26782 - RNA, 20 nt, Artificial Sequence
  targeting sequence with TTCN PAM
agauugccacuugguggcag

SEQ ID NO: 26783 - RNA, 20 nt, Artificial Sequence
  targeting sequence with TTCN PAM
gcuaauuuauggcuuucuag

SEQ ID NO: 26784 - RNA, 20 nt, Artificial Sequence
  targeting sequence with TTCN PAM
cugugaacucaaggcuacua

SEQ ID NO: 26785 - RNA, 20 nt, Artificial Sequence
  targeting sequence with TTCN PAM
cagggaacucuuuuauucag

SEQ ID NO: 26786 - RNA, 20 nt, Artificial Sequence
  targeting sequence with TTCN PAM
acuaaacucuaguagccuug

SEQ ID NO: 26787 - RNA, 20 nt, Artificial Sequence
  targeting sequence with TTCN PAM
uguuccacuaaacucuagua

SEQ ID NO: 26788 - RNA, 20 nt, Artificial Sequence
  targeting sequence with TTCN PAM
ugaugacuacucucagaaga

SEQ ID NO: 26789 - RNA, 20 nt, Artificial Sequence
  targeting sequence with TTCN PAM
gagaguagucaucaggaaca

SEQ ID NO: 26790 - RNA, 20 nt, Artificial Sequence
  targeting sequence with TTCN PAM
aauauuuuaugggcacuguc

SEQ ID NO: 26791 - RNA, 20 nt, Artificial Sequence
  targeting sequence with TTCN PAM
uucaugccugugauuccauu

SEQ ID NO: 26792 - RNA, 20 nt, Artificial Sequence
  targeting sequence with TTCN PAM
ugccugugauuccauuaccu

SEQ ID NO: 26793 - RNA, 20 nt, Artificial Sequence
  targeting sequence with TTCN PAM
auuaccuaaucucuucauaa

SEQ ID NO: 26794 - RNA, 20 nt, Artificial Sequence
  targeting sequence with TTCN PAM
uaacagaggagcauaaacag

SEQ ID NO: 26795 - RNA, 20 nt, Artificial Sequence
  targeting sequence with TTCN PAM
uacuuucuaaaugccacaaa

SEQ ID NO: 26796 - RNA, 20 nt, Artificial Sequence
  targeting sequence with TTCN PAM
aaaugccacaaaauuguuug

SEQ ID NO: 26797 - RNA, 20 nt, Artificial Sequence
  targeting sequence with TTCN PAM
uaaauuaggcaaaugaauaa

SEQ ID NO: 26798 - RNA, 20 nt, Artificial Sequence
  targeting sequence with TTCN PAM
uuugccuaauuuaggaacaa

SEQ ID NO: 26799 - RNA, 20 nt, Artificial Sequence
  targeting sequence with TTCN PAM
caugguuguuauucauuugc

SEQ ID NO: 26800 - RNA, 20 nt, Artificial Sequence
  targeting sequence with TTCN PAM
auucucaugguuguuauuca

SEQ ID NO: 26801 - RNA, 20 nt, Artificial Sequence
  targeting sequence with TTCN PAM
uugccuuucacccaaauucu

SEQ ID NO: 26802 - RNA, 20 nt, Artificial Sequence
  targeting sequence with TTCN PAM
cccaaauucuuuguggcucc

SEQ ID NO: 26803 - RNA, 20 nt, Artificial Sequence
  targeting sequence with TTCN PAM
uuguggcuccacugaaaucu

SEQ ID NO: 26804 - RNA, 20 nt, Artificial Sequence
  targeting sequence with TTCN PAM
guggagccacaaagaauuug

SEQ ID NO: 26805 - RNA, 20 nt, Artificial Sequence
  targeting sequence with TTCN PAM
ugauugugcauugguuuugu

SEQ ID NO: 26806 - RNA, 20 nt, Artificial Sequence
  targeting sequence with TTCN PAM
uaucuuucccuuugggagaa

SEQ ID NO: 26807 - RNA, 20 nt, Artificial Sequence
  targeting sequence with TTCN PAM
cuuugggagaaccaagaaag

SEQ ID NO: 26808 - RNA, 20 nt, Artificial Sequence
  targeting sequence with TTCN PAM
cccaaagggaaagauaugaa

SEQ ID NO: 26809 - RNA, 20 nt, Artificial Sequence
  targeting sequence with TTCN PAM
ugguucucccaaagggaaag

SEQ ID NO: 26810 - RNA, 20 nt, Artificial Sequence
  targeting sequence with TTCN PAM
uucuugguucucccaaaggg

SEQ ID NO: 26811 - RNA, 20 nt, Artificial Sequence
  targeting sequence with TTCN PAM
ggugcuccuugugggcaaaa

SEQ ID NO: 26812 - RNA, 20 nt, Artificial Sequence
  targeting sequence with TTCN PAM
aaccaaauaugaaauaaaca

SEQ ID NO: 26813 - RNA, 20 nt, Artificial Sequence
  targeting sequence with TTCN PAM
uauuugguuagaaggggaua

SEQ ID NO: 26814 - RNA, 20 nt, Artificial Sequence
  targeting sequence with TTCN PAM
ucaugaguuugucuugcugg

SEQ ID NO: 26815 - RNA, 20 nt, Artificial Sequence
  targeting sequence with TTCN PAM
guaacuauuagccagcaaga

SEQ ID NO: 26816 - RNA, 20 nt, Artificial Sequence
  targeting sequence with TTCN PAM
uucaguaacuauuagccagc

SEQ ID NO: 26817 - RNA, 20 nt, Artificial Sequence
  targeting sequence with TTCN PAM
cagaggaaaagggcuaaugu

SEQ ID NO: 26818 - RNA, 20 nt, Artificial Sequence
  targeting sequence with TTCN PAM
ucugagaaacucaauucuuu

SEQ ID NO: 26819 - RNA, 20 nt, Artificial Sequence
  targeting sequence with TTCN PAM
ugcacugggcuauuuagauc

SEQ ID NO: 26820 - RNA, 20 nt, Artificial Sequence
  targeting sequence with TTCN PAM
caggaucuaaauagcccagu

SEQ ID NO: 26821 - RNA, 20 nt, Artificial Sequence
  targeting sequence with TTCN PAM
cacccucccaucuucucagg

SEQ ID NO: 26822 - RNA, 20 nt, Artificial Sequence
  targeting sequence with TTCN PAM
gcugcuuucacacccuccca

SEQ ID NO: 26823 - RNA, 20 nt, Artificial Sequence
  targeting sequence with TTCN PAM
guacuguucugcugcuuuca

SEQ ID NO: 26824 - RNA, 20 nt, Artificial Sequence
  targeting sequence with TTCN PAM
ucuauuugcacauuauuagc

SEQ ID NO: 26825 - RNA, 20 nt, Artificial Sequence
  targeting sequence with TTCN PAM
aacaacaacaacaaaaauca

SEQ ID NO: 26826 - RNA, 20 nt, Artificial Sequence
  targeting sequence with TTCN PAM
ugcugucuuuuaaucucaug

SEQ ID NO: 26827 - RNA, 20 nt, Artificial Sequence
  targeting sequence with TTCN PAM
uuuauucuugcugucuuuua

SEQ ID NO: 26828 - RNA, 20 nt, Artificial Sequence
  targeting sequence with TTCN PAM
acuugucucauaugcaaagg

SEQ ID NO: 26829 - RNA, 20 nt, Artificial Sequence
  targeting sequence with TTCN PAM
uaguaccuuugcauaugaga

SEQ ID NO: 26830 - RNA, 20 nt, Artificial Sequence
  targeting sequence with TTCN PAM
aaggcaaaacuuaccuuaau

SEQ ID NO: 26831 - RNA, 20 nt, Artificial Sequence
  targeting sequence with TTCN PAM
uuagggcugcaugcuaagug

SEQ ID NO: 26832 - RNA, 20 nt, Artificial Sequence
  targeting sequence with TTCN PAM
aaauuauuaccuuaaaacuu

SEQ ID NO: 26833 - RNA, 20 nt, Artificial Sequence
  targeting sequence with TTCN PAM
uagugcugcuauuaugcaga

SEQ ID NO: 26834 - RNA, 20 nt, Artificial Sequence
  targeting sequence with TTCN PAM
aaaccuuaacuaguuucuua

SEQ ID NO: 26835 - RNA, 20 nt, Artificial Sequence
  targeting sequence with TTCN PAM
guaggccaauagaaaaucuu

SEQ ID NO: 26836 - RNA, 20 nt, Artificial Sequence
  targeting sequence with TTCN PAM
auuggccuacagaaaauuuu

SEQ ID NO: 26837 - RNA, 20 nt, Artificial Sequence
  targeting sequence with TTCN PAM
uacugucagcaauuuuauag

SEQ ID NO: 26838 - RNA, 20 nt, Artificial Sequence
  targeting sequence with TTCN PAM
uuugugcuugcauucuuacu

SEQ ID NO: 26839 - RNA, 20 nt, Artificial Sequence
  targeting sequence with TTCN PAM
auagucucaaaguuguacag

SEQ ID NO: 26840 - RNA, 20 nt, Artificial Sequence
  targeting sequence with TTCN PAM
uuucuucuguaugucuuaca

SEQ ID NO: 26841 - RNA, 20 nt, Artificial Sequence
  targeting sequence with TTCN PAM
ucuguaugucuuacagaggc

SEQ ID NO: 26842 - RNA, 20 nt, Artificial Sequence
  targeting sequence with TTCN PAM
guaugucuuacagaggcuca

SEQ ID NO: 26843 - RNA, 20 nt, Artificial Sequence
  targeting sequence with TTCN PAM
uuugagccucuguaagacau

SEQ ID NO: 26844 - RNA, 20 nt, Artificial Sequence
  targeting sequence with TTCN PAM
uauucauuugagccucugua

SEQ ID NO: 26845 - RNA, 20 nt, Artificial Sequence
  targeting sequence with TTCN PAM
ccaauuaacuauuuauuuau

SEQ ID NO: 26846 - RNA, 20 nt, Artificial Sequence
  targeting sequence with TTCN PAM
ggguucaagcaauucuccua

SEQ ID NO: 26847 - RNA, 20 nt, Artificial Sequence
  targeting sequence with TTCN PAM
agcaauucuccuaccucugc

SEQ ID NO: 26848 - RNA, 20 nt, Artificial Sequence
  targeting sequence with TTCN PAM
ccuaccucugccucucaagu

SEQ ID NO: 26849 - RNA, 20 nt, Artificial Sequence
  targeting sequence with TTCN PAM
ccauguugaccaggcugguc

SEQ ID NO: 26850 - RNA, 20 nt, Artificial Sequence
  targeting sequence with TTCN PAM
agaccagccuggucaacaug

SEQ ID NO: 26851 - RNA, 20 nt, Artificial Sequence
  targeting sequence with TTCN PAM
uaccaaaaagcauuugauag

SEQ ID NO: 26852 - RNA, 20 nt, Artificial Sequence
  targeting sequence with TTCN PAM
uucuuaccaaaaagcauuug

SEQ ID NO: 26853 - RNA, 20 nt, Artificial Sequence
  targeting sequence with TTCN PAM
cucagcuucucugaaaagua

SEQ ID NO: 26854 - RNA, 20 nt, Artificial Sequence
  targeting sequence with TTCN PAM
cugaaaaguaaaguuauuau

SEQ ID NO: 26855 - RNA, 20 nt, Artificial Sequence
  targeting sequence with TTCN PAM
gagaagcugagugaauaaaa

SEQ ID NO: 26856 - RNA, 20 nt, Artificial Sequence
  targeting sequence with TTCN PAM
cccucugguuuacuuauaau

SEQ ID NO: 26857 - RNA, 20 nt, Artificial Sequence
  targeting sequence with TTCN PAM
cuuucucccucugguuuacu

SEQ ID NO: 26858 - RNA, 20 nt, Artificial Sequence
  targeting sequence with TTCN PAM
uguguccuuuugcuccuuuu

SEQ ID NO: 26859 - RNA, 20 nt, Artificial Sequence
  targeting sequence with TTCN PAM
accucuccccuuuuuccugu

SEQ ID NO: 26860 - RNA, 20 nt, Artificial Sequence
  targeting sequence with TTCN PAM
cuccuucgaccucuccccuu

SEQ ID NO: 26861 - RNA, 20 nt, Artificial Sequence
  targeting sequence with TTCN PAM
accucuccccuuucacuccu

SEQ ID NO: 26862 - RNA, 20 nt, Artificial Sequence
  targeting sequence with TTCN PAM
ucaccuuuugcuccuucuac

SEQ ID NO: 26863 - RNA, 20 nt, Artificial Sequence
  targeting sequence with TTCN PAM
aauaauuugguaaguucuca

SEQ ID NO: 26864 - RNA, 20 nt, Artificial Sequence
  targeting sequence with TTCN PAM
cagaauuuucaacaauuaac

SEQ ID NO: 26865 - RNA, 20 nt, Artificial Sequence
  targeting sequence with TTCN PAM
gagaacuuaccaaauuauuu

SEQ ID NO: 26866 - RNA, 20 nt, Artificial Sequence
  targeting sequence with TTCN PAM
acaauuaacuuuucuagcac

SEQ ID NO: 26867 - RNA, 20 nt, Artificial Sequence
  targeting sequence with TTCN PAM
agcacaauuuuacugaagac

SEQ ID NO: 26868 - RNA, 20 nt, Artificial Sequence
  targeting sequence with TTCN PAM
guaaaauugugcuagaaaag

SEQ ID NO: 26869 - RNA, 20 nt, Artificial Sequence
  targeting sequence with TTCN PAM
gagugugagcuaauggcaua

SEQ ID NO: 26870 - RNA, 20 nt, Artificial Sequence
  targeting sequence with TTCN PAM
aaauuaguaucagaaauaag

SEQ ID NO: 26871 - RNA, 20 nt, Artificial Sequence
  targeting sequence with TTCN PAM
gauacuaauuuagaacaacu

SEQ ID NO: 26872 - RNA, 20 nt, Artificial Sequence
  targeting sequence with TTCN PAM
cuuauuucugauacuaauuu

SEQ ID NO: 26873 - RNA, 20 nt, Artificial Sequence
  targeting sequence with TTCN PAM
acaaaaucacagcaaauuau

SEQ ID NO: 26874 - RNA, 20 nt, Artificial Sequence
  targeting sequence with TTCN PAM
cuuaaguuuuucuuuccaau

SEQ ID NO: 26875 - RNA, 20 nt, Artificial Sequence
  targeting sequence with TTCN PAM
uuccaauuuuuuaguuuuuu

SEQ ID NO: 26876 - RNA, 20 nt, Artificial Sequence
  targeting sequence with TTCN PAM
aauuuuuuaguuuuuugaua

SEQ ID NO: 26877 - RNA, 20 nt, Artificial Sequence
  targeting sequence with TTCN PAM
uguccaaaccaaaaaagcuu

SEQ ID NO: 26878 - RNA, 20 nt, Artificial Sequence
  targeting sequence with TTCN PAM
cugacuacaaagaguuggau

SEQ ID NO: 26879 - RNA, 20 nt, Artificial Sequence
  targeting sequence with TTCN PAM
ucacucuuccuuaagcacuu

SEQ ID NO: 26880 - RNA, 20 nt, Artificial Sequence
  targeting sequence with TTCN PAM
uuaagcacuucuaaggugua

SEQ ID NO: 26881 - RNA, 20 nt, Artificial Sequence
  targeting sequence with TTCN PAM
aagguguacaauccuuuuag

SEQ ID NO: 26882 - RNA, 20 nt, Artificial Sequence
  targeting sequence with TTCN PAM
uaaaaggauuguacaccuua

SEQ ID NO: 26883 - RNA, 20 nt, Artificial Sequence
  targeting sequence with TTCN PAM
gcuuuuccuaaaaggauugu

SEQ ID NO: 26884 - RNA, 20 nt, Artificial Sequence
  targeting sequence with TTCN PAM
uaauauuugcuuuucagcuu

SEQ ID NO: 26885 - RNA, 20 nt, Artificial Sequence
  targeting sequence with TTCN PAM
caccuuguaauucuuaauau

SEQ ID NO: 26886 - RNA, 20 nt, Artificial Sequence
  targeting sequence with TTCN PAM
ccaucuaaguuucucaccuu

SEQ ID NO: 26887 - RNA, 20 nt, Artificial Sequence
  targeting sequence with TTCN PAM
gcauaucuguaaaagguaag

SEQ ID NO: 26888 - RNA, 20 nt, Artificial Sequence
  targeting sequence with TTCN PAM
gucguuuucugcauaucugu

SEQ ID NO: 26889 - RNA, 20 nt, Artificial Sequence
  targeting sequence with TTCN PAM
accagugagagaugagggcu

SEQ ID NO: 26890 - RNA, 20 nt, Artificial Sequence
  targeting sequence with TTCN PAM
aguacuuuucaguauuuucu

SEQ ID NO: 26891 - RNA, 20 nt, Artificial Sequence
  targeting sequence with TTCN PAM
guauuuucuaauuuuuuaaa

SEQ ID NO: 26892 - RNA, 20 nt, Artificial Sequence
  targeting sequence with TTCN PAM
aauuuuuuaaaguauaauca

SEQ ID NO: 26893 - RNA, 20 nt, Artificial Sequence
  targeting sequence with TTCN PAM
ugauuauacuuuaaaaaauu

SEQ ID NO: 26894 - RNA, 20 nt, Artificial Sequence
  targeting sequence with TTCN PAM
uguaccuguuuuauauuuca

SEQ ID NO: 26895 - RNA, 20 nt, Artificial Sequence
  targeting sequence with TTCN PAM
aguaguuuccuaaucuguau

SEQ ID NO: 26896 - RNA, 20 nt, Artificial Sequence
  targeting sequence with TTCN PAM
uaaucuguaucugccauucu

SEQ ID NO: 26897 - RNA, 20 nt, Artificial Sequence
  targeting sequence with TTCN PAM
cuauucaaaggcaauucuaa

SEQ ID NO: 26898 - RNA, 20 nt, Artificial Sequence
  targeting sequence with TTCN PAM
aaggcaauucuaaaaauccu

SEQ ID NO: 26899 - RNA, 20 nt, Artificial Sequence
  targeting sequence with TTCN PAM
aaaaauccuaucuuaggcca

SEQ ID NO: 26900 - RNA, 20 nt, Artificial Sequence
  targeting sequence with TTCN PAM
ugccucggagugcugggauu

SEQ ID NO: 26901 - RNA, 20 nt, Artificial Sequence
  targeting sequence with TTCN PAM
ugggcucagaugaucuuccu

SEQ ID NO: 26902 - RNA, 20 nt, Artificial Sequence
  targeting sequence with TTCN PAM
ucgagggcagggucauaugc

SEQ ID NO: 26903 - RNA, 20 nt, Artificial Sequence
  targeting sequence with TTCN PAM
guccuagauuaauuccucga

SEQ ID NO: 26904 - RNA, 20 nt, Artificial Sequence
  targeting sequence with TTCN PAM
uguauggacaucuuauuuuc

SEQ ID NO: 26905 - RNA, 20 nt, Artificial Sequence
  targeting sequence with TTCN PAM
guauguuucauguauggaca

SEQ ID NO: 26906 - RNA, 20 nt, Artificial Sequence
  targeting sequence with TTCN PAM
ccacuuguuuaguuuugugc

SEQ ID NO: 26907 - RNA, 20 nt, Artificial Sequence
  targeting sequence with TTCN PAM
uacacacuucaccacuuguu

SEQ ID NO: 26908 - RNA, 20 nt, Artificial Sequence
  targeting sequence with TTCN PAM
ugacuuuuaaugguaauugc

SEQ ID NO: 26909 - RNA, 20 nt, Artificial Sequence
  targeting sequence with TTCN PAM
aacugaucuuccugacuuuu

SEQ ID NO: 26910 - RNA, 20 nt, Artificial Sequence
  targeting sequence with TTCN PAM
caaacaaauccaauucuaac

SEQ ID NO: 26911 - RNA, 20 nt, Artificial Sequence
  targeting sequence with TTCN PAM
ucaggcuuucccaaacaaau

SEQ ID NO: 26912 - RNA, 20 nt, Artificial Sequence
  targeting sequence with TTCN PAM
gagcucaguaaaagcugcug

SEQ ID NO: 26913 - RNA, 20 nt, Artificial Sequence
  targeting sequence with TTCN PAM
gcuuauuuauccauugucuc

SEQ ID NO: 26914 - RNA, 20 nt, Artificial Sequence
  targeting sequence with TTCN PAM
gccagcaggcaguaaucaca

SEQ ID NO: 26915 - RNA, 20 nt, Artificial Sequence
  targeting sequence with TTCN PAM
cuccucucaugcaucuuaca

SEQ ID NO: 26916 - RNA, 20 nt, Artificial Sequence
  targeting sequence with TTCN PAM
cugauuaucaucuuucccuc

SEQ ID NO: 26917 - RNA, 20 nt, Artificial Sequence
  targeting sequence with TTCN PAM
uuaccuaauuucucugauua

SEQ ID NO: 26918 - RNA, 20 nt, Artificial Sequence
  targeting sequence with TTCN PAM
aaauuauaaguuccuuaccu

SEQ ID NO: 26919 - RNA, 20 nt, Artificial Sequence
  targeting sequence with TTCN PAM
uugucaucuuuuucuaaauu

SEQ ID NO: 26920 - RNA, 20 nt, Artificial Sequence
  targeting sequence with TTCN PAM
cagccauacuaaugggcuca

SEQ ID NO: 26921 - RNA, 20 nt, Artificial Sequence
  targeting sequence with TTCN PAM
auucccagccauacuaaugg

SEQ ID NO: 26922 - RNA, 20 nt, Artificial Sequence
  targeting sequence with TTCN PAM
auuaacuuuuuuauuccauu

SEQ ID NO: 26923 - RNA, 20 nt, Artificial Sequence
  targeting sequence with TTCN PAM
uuuccauuaacuuuuuuauu

SEQ ID NO: 26924 - RNA, 20 nt, Artificial Sequence
  targeting sequence with TTCN PAM
guacuuugugcgcucauucc

SEQ ID NO: 26925 - RNA, 20 nt, Artificial Sequence
  targeting sequence with TTCN PAM
uguugacucuucaguacuuu

SEQ ID NO: 26926 - RNA, 20 nt, Artificial Sequence
  targeting sequence with TTCN PAM
ucauaccauugcgacagaug

SEQ ID NO: 26927 - RNA, 20 nt, Artificial Sequence
  targeting sequence with TTCN PAM
cagcuggaaacguauuacga

SEQ ID NO: 26928 - RNA, 20 nt, Artificial Sequence
  targeting sequence with TTCN PAM
agcugagaacuauaaauacu

SEQ ID NO: 26929 - RNA, 20 nt, Artificial Sequence
  targeting sequence with TTCN PAM
uccuccugcaucuuauuuca

SEQ ID NO: 26930 - RNA, 20 nt, Artificial Sequence
  targeting sequence with TTCN PAM
acaauuaaaugucauccaua

SEQ ID NO: 26931 - RNA, 20 nt, Artificial Sequence
  targeting sequence with TTCN PAM
uuuagccccaaagaaauuga

SEQ ID NO: 26932 - RNA, 20 nt, Artificial Sequence
  targeting sequence with TTCN PAM
uuggggcuaaaugaaguaug

SEQ ID NO: 26933 - RNA, 20 nt, Artificial Sequence
  targeting sequence with TTCN PAM
uugcauccagccuugguaag

SEQ ID NO: 26934 - RNA, 20 nt, Artificial Sequence
  targeting sequence with TTCN PAM
uuuagaccugcuuaaauauu

SEQ ID NO: 26935 - RNA, 20 nt, Artificial Sequence
  targeting sequence with TTCN PAM
agcagaaagagaucauuuac

SEQ ID NO: 26936 - RNA, 20 nt, Artificial Sequence
  targeting sequence with TTCN PAM
gcuugaaagaguauauuuug

SEQ ID NO: 26937 - RNA, 20 nt, Artificial Sequence
  targeting sequence with TTCN PAM
acauauggucaauuuuugua

SEQ ID NO: 26938 - RNA, 20 nt, Artificial Sequence
  targeting sequence with TTCN PAM
guuuuuuuaaaauuugugag

SEQ ID NO: 26939 - RNA, 20 nt, Artificial Sequence
  targeting sequence with TTCN PAM
cugaccacaauguggauucc

SEQ ID NO: 26940 - RNA, 20 nt, Artificial Sequence
  targeting sequence with TTCN PAM
ugagguucaaaaagagcugg

SEQ ID NO: 26941 - RNA, 20 nt, Artificial Sequence
  targeting sequence with TTCN PAM
aaaagagcugggaggaaauc

SEQ ID NO: 26942 - RNA, 20 nt, Artificial Sequence
  targeting sequence with TTCN PAM
ucccagcucuuuuugaaccu

SEQ ID NO: 26943 - RNA, 20 nt, Artificial Sequence
  targeting sequence with TTCN PAM
uuuuuuguuuacugcuaucc

SEQ ID NO: 26944 - RNA, 20 nt, Artificial Sequence
  targeting sequence with TTCN PAM
uuuggucagagacaaggcuu

SEQ ID NO: 26945 - RNA, 20 nt, Artificial Sequence
  targeting sequence with TTCN PAM
augcucuugggacuguuucc

SEQ ID NO: 26946 - RNA, 20 nt, Artificial Sequence
  targeting sequence with TTCN PAM
uccaugcucuugggacuguu

SEQ ID NO: 26947 - RNA, 20 nt, Artificial Sequence
  targeting sequence with TTCN PAM
uaucugcacugggauucuuc

SEQ ID NO: 26948 - RNA, 20 nt, Artificial Sequence
  targeting sequence with TTCN PAM
gacaaacugcugaagacuga

SEQ ID NO: 26949 - RNA, 20 nt, Artificial Sequence
  targeting sequence with TTCN PAM
gcaguuugucagaauuuuug

SEQ ID NO: 26950 - RNA, 20 nt, Artificial Sequence
  targeting sequence with TTCN PAM
gucuucagcaguuugucaga

SEQ ID NO: 26951 - RNA, 20 nt, Artificial Sequence
  targeting sequence with TTCN PAM
aaccuacauucagucuucag

SEQ ID NO: 26952 - RNA, 20 nt, Artificial Sequence
  targeting sequence with TTCN PAM
cacucugauucuaaccuaca

SEQ ID NO: 26953 - RNA, 20 nt, Artificial Sequence
  targeting sequence with TTCN PAM
cauccucuugugggcuuuuc

SEQ ID NO: 26954 - RNA, 20 nt, Artificial Sequence
  targeting sequence with TTCN PAM
uccaggaaccucaaaaggcu

SEQ ID NO: 26955 - RNA, 20 nt, Artificial Sequence
  targeting sequence with TTCN PAM
uggaggaaaagcccacaaga

SEQ ID NO: 26956 - RNA, 20 nt, Artificial Sequence
  targeting sequence with TTCN PAM
cccugcauuagagagccuuu

SEQ ID NO: 26957 - RNA, 20 nt, Artificial Sequence
  targeting sequence with TTCN PAM
ucucugcuucccccugcauu

SEQ ID NO: 26958 - RNA, 20 nt, Artificial Sequence
  targeting sequence with TTCN PAM
cuacuuccucucugcuuccc

SEQ ID NO: 26959 - RNA, 20 nt, Artificial Sequence
  targeting sequence with TTCN PAM
cucauuagcuccacgggggu

SEQ ID NO: 26960 - RNA, 20 nt, Artificial Sequence
  targeting sequence with TTCN PAM
cuuaucucccuguggaacaa

SEQ ID NO: 26961 - RNA, 20 nt, Artificial Sequence
  targeting sequence with TTCN PAM
acagggagauaagggaaaua

SEQ ID NO: 26962 - RNA, 20 nt, Artificial Sequence
  targeting sequence with TTCN PAM
gguggaaucccacuacagcu

SEQ ID NO: 26963 - RNA, 20 nt, Artificial Sequence
  targeting sequence with TTCN PAM
accagaaauugcuccuugcu

SEQ ID NO: 26964 - RNA, 20 nt, Artificial Sequence
  targeting sequence with TTCN PAM
uccagcuguagugggauucc

SEQ ID NO: 26965 - RNA, 20 nt, Artificial Sequence
  targeting sequence with TTCN PAM
uuccuccagcuguaguggga

SEQ ID NO: 26966 - RNA, 20 nt, Artificial Sequence
  targeting sequence with TTCN PAM
uuuccuuccuccagcuguag

SEQ ID NO: 26967 - RNA, 20 nt, Artificial Sequence
  targeting sequence with TTCN PAM
cccuuauccaucuucacugu

SEQ ID NO: 26968 - RNA, 20 nt, Artificial Sequence
  targeting sequence with TTCN PAM
cuguuucucuaaaacagcaa

SEQ ID NO: 26969 - RNA, 20 nt, Artificial Sequence
  targeting sequence with TTCN PAM
cuaaaacagcaauagccuua

SEQ ID NO: 26970 - RNA, 20 nt, Artificial Sequence
  targeting sequence with TTCN PAM
gccugcauuuaaggcuauug

SEQ ID NO: 26971 - RNA, 20 nt, Artificial Sequence
  targeting sequence with TTCN PAM
gcucuuuccgccugcauuua

SEQ ID NO: 26972 - RNA, 20 nt, Artificial Sequence
  targeting sequence with TTCN PAM
auaguauccucaagcuaagg

SEQ ID NO: 26973 - RNA, 20 nt, Artificial Sequence
  targeting sequence with TTCN PAM
caacugcuauggggauucaa

SEQ ID NO: 26974 - RNA, 20 nt, Artificial Sequence
  targeting sequence with TTCN PAM
uuuucccaacugcuaugggg

SEQ ID NO: 26975 - RNA, 20 nt, Artificial Sequence
  targeting sequence with TTCN PAM
cuucuuuuucccaacugcua

SEQ ID NO: 26976 - RNA, 20 nt, Artificial Sequence
  targeting sequence with TTCN PAM
gaaggccacacccccaagac

SEQ ID NO: 26977 - RNA, 20 nt, Artificial Sequence
  targeting sequence with TTCN PAM
gaagacuauucccuucuuuu

SEQ ID NO: 26978 - RNA, 20 nt, Artificial Sequence
  targeting sequence with TTCN PAM
acuaucugcauaaaucugag

SEQ ID NO: 26979 - RNA, 20 nt, Artificial Sequence
  targeting sequence with TTCN PAM
gguuaagccucagauuuaug

SEQ ID NO: 26980 - RNA, 20 nt, Artificial Sequence
  targeting sequence with TTCN PAM
gugauguucugguuaagccu

SEQ ID NO: 26981 - RNA, 20 nt, Artificial Sequence
  targeting sequence with TTCN PAM
auuguuuuuacucaaagccu

SEQ ID NO: 26982 - RNA, 20 nt, Artificial Sequence
  targeting sequence with TTCN PAM
cagguguauuccauuguuuu

SEQ ID NO: 26983 - RNA, 20 nt, Artificial Sequence
  targeting sequence with TTCN PAM
ccgugagagucugagucuug

SEQ ID NO: 26984 - RNA, 20 nt, Artificial Sequence
  targeting sequence with TTCN PAM
cuuugugcuguuucuccgug

SEQ ID NO: 26985 - RNA, 20 nt, Artificial Sequence
  targeting sequence with TTCN PAM
ugcuuggcuuuggguuuucc

SEQ ID NO: 26986 - RNA, 20 nt, Artificial Sequence
  targeting sequence with TTCN PAM
ugucuuccugcuuggcuuug

SEQ ID NO: 26987 - RNA, 20 nt, Artificial Sequence
  targeting sequence with TTCN PAM
caguaauaccuuguucuugu

SEQ ID NO: 26988 - RNA, 20 nt, Artificial Sequence
  targeting sequence with TTCN PAM
aauuuucccaguaauaccuu

SEQ ID NO: 26989 - RNA, 20 nt, Artificial Sequence
  targeting sequence with TTCN PAM
cauggcaacaauaaauguca

SEQ ID NO: 26990 - RNA, 20 nt, Artificial Sequence
  targeting sequence with TTCN PAM
ggcauugggcuguguuugau

SEQ ID NO: 26991 - RNA, 20 nt, Artificial Sequence
  targeting sequence with TTCN PAM
ugcaaguccuuuagggugga

SEQ ID NO: 26992 - RNA, 20 nt, Artificial Sequence
  targeting sequence with TTCN PAM
guaagcauaucaagcauaua

SEQ ID NO: 26993 - RNA, 20 nt, Artificial Sequence
  targeting sequence with TTCN PAM
gcuuuaaacaaaaauuauga

SEQ ID NO: 26994 - RNA, 20 nt, Artificial Sequence
  targeting sequence with TTCN PAM
uaauuuuuguuuaaagcuga

SEQ ID NO: 26995 - RNA, 20 nt, Artificial Sequence
  targeting sequence with TTCN PAM
aaaauuuaugucauacgugg

SEQ ID NO: 26996 - RNA, 20 nt, Artificial Sequence
  targeting sequence with TTCN PAM
aauuuacugucuuguaguuc

SEQ ID NO: 26997 - RNA, 20 nt, Artificial Sequence
  targeting sequence with TTCN PAM
uuagaguuuuuacuguauua

SEQ ID NO: 26998 - RNA, 20 nt, Artificial Sequence
  targeting sequence with TTCN PAM
gagauaaaugaaaauuauaa

SEQ ID NO: 26999 - RNA, 20 nt, Artificial Sequence
  targeting sequence with TTCN PAM
uuuaucucugaaauuaccug

SEQ ID NO: 27000 - RNA, 20 nt, Artificial Sequence
  targeting sequence with TTCN PAM
acuugauuuuuuauaauuuu

SEQ ID NO: 27001 - RNA, 20 nt, Artificial Sequence
  targeting sequence with TTCN PAM
aauuugguuuccacuugauu

SEQ ID NO: 27002 - RNA, 20 nt, Artificial Sequence
  targeting sequence with TTCN PAM
agucuacuugauaagccucu

SEQ ID NO: 27003 - RNA, 20 nt, Artificial Sequence
  targeting sequence with TTCN PAM
gcuguuucaagucuacuuga

SEQ ID NO: 27004 - RNA, 20 nt, Artificial Sequence
  targeting sequence with TTCN PAM
uuuuucagcuguuucaaguc

SEQ ID NO: 27005 - RNA, 20 nt, Artificial Sequence
  targeting sequence with TTCN PAM
aguuuacugauucuuuuuuc

SEQ ID NO: 27006 - RNA, 20 nt, Artificial Sequence
  targeting sequence with TTCN PAM
acuagccuauuuucaaguuu

SEQ ID NO: 27007 - RNA, 20 nt, Artificial Sequence
  targeting sequence with TTCN PAM
guuuggguaguuucuacuag

SEQ ID NO: 27008 - RNA, 20 nt, Artificial Sequence
  targeting sequence with TTCN PAM
cuuuauauuucaguuugggu

SEQ ID NO: 27009 - RNA, 20 nt, Artificial Sequence
  targeting sequence with TTCN PAM
caccuggagaacauacaaca

SEQ ID NO: 27010 - RNA, 20 nt, Artificial Sequence
  targeting sequence with TTCN PAM
ccaggugggaaaaucucuuu

SEQ ID NO: 27011 - RNA, 20 nt, Artificial Sequence
  targeting sequence with TTCN PAM
gccacagcuguuguauguuc

SEQ ID NO: 27012 - RNA, 20 nt, Artificial Sequence
  targeting sequence with TTCN PAM
ggacuucugccacagcuguu

SEQ ID NO: 27013 - RNA, 20 nt, Artificial Sequence
  targeting sequence with TTCN PAM
ucuggacuucugccacagcu

SEQ ID NO: 27014 - RNA, 20 nt, Artificial Sequence
  targeting sequence with TTCN PAM
cuguugucucuucuucugga

SEQ ID NO: 27015 - RNA, 20 nt, Artificial Sequence
  targeting sequence with TTCN PAM
ucucuguugucucuucuucu

SEQ ID NO: 27016 - RNA, 20 nt, Artificial Sequence
  targeting sequence with TTCN PAM
aauguuucuucucuguuguc

SEQ ID NO: 27017 - RNA, 20 nt, Artificial Sequence
  targeting sequence with TTCN PAM
uggccauucaaauguuucuu

SEQ ID NO: 27018 - RNA, 20 nt, Artificial Sequence
  targeting sequence with TTCN PAM
guaaguucuuggccauucaa

SEQ ID NO: 27019 - RNA, 20 nt, Artificial Sequence
  targeting sequence with TTCN PAM
uauuguuacucuguaguuua

SEQ ID NO: 27020 - RNA, 20 nt, Artificial Sequence
  targeting sequence with TTCN PAM
gaguuucuuauuguuacucu

SEQ ID NO: 27021 - RNA, 20 nt, Artificial Sequence
  targeting sequence with TTCN PAM
aaagugcugggauuauaggc

SEQ ID NO: 27022 - RNA, 20 nt, Artificial Sequence
  targeting sequence with TTCN PAM
cggcugauuuuuuuguuuau

SEQ ID NO: 27023 - RNA, 20 nt, Artificial Sequence
  targeting sequence with TTCN PAM
caaguagcugggaccacagg

SEQ ID NO: 27024 - RNA, 20 nt, Artificial Sequence
  targeting sequence with TTCN PAM
agccuggaugacagggcaag

SEQ ID NO: 27025 - RNA, 20 nt, Artificial Sequence
  targeting sequence with TTCN PAM
uuuauuuuuugagacagggu

SEQ ID NO: 27026 - RNA, 20 nt, Artificial Sequence
  targeting sequence with TTCN PAM
caucacugcacuucaaccug

SEQ ID NO: 27027 - RNA, 20 nt, Artificial Sequence
  targeting sequence with TTCN PAM
accugggcaacagagugaga

SEQ ID NO: 27028 - RNA, 20 nt, Artificial Sequence
  targeting sequence with TTCN PAM
uuuuauuuuuuugagacaga

SEQ ID NO: 27029 - RNA, 20 nt, Artificial Sequence
  targeting sequence with TTCN PAM
uuuguuuuuucuuuuuauuu

SEQ ID NO: 27030 - RNA, 20 nt, Artificial Sequence
  targeting sequence with TTCN PAM
cccaacgccuuuuggcugcc

SEQ ID NO: 27031 - RNA, 20 nt, Artificial Sequence
  targeting sequence with TTCN PAM
cuuuugggcugggcauggug

SEQ ID NO: 27032 - RNA, 20 nt, Artificial Sequence
  targeting sequence with TTCN PAM
caggaggcugaggugggagg

SEQ ID NO: 27033 - RNA, 20 nt, Artificial Sequence
  targeting sequence with TTCN PAM
guggauccucccaccucagc

SEQ ID NO: 27034 - RNA, 20 nt, Artificial Sequence
  targeting sequence with TTCN PAM
auaaguagugugauaauagc

SEQ ID NO: 27035 - RNA, 20 nt, Artificial Sequence
  targeting sequence with TTCN PAM
cuucuauaaguagugugaua

SEQ ID NO: 27036 - RNA, 20 nt, Artificial Sequence
  targeting sequence with TTCN PAM
gauuuuaaaaacaucuccca

SEQ ID NO: 27037 - RNA, 20 nt, Artificial Sequence
  targeting sequence with TTCN PAM
ccuucacugcaggucauuug

SEQ ID NO: 27038 - RNA, 20 nt, Artificial Sequence
  targeting sequence with TTCN PAM
cugcaggucauuugaaaugg

SEQ ID NO: 27039 - RNA, 20 nt, Artificial Sequence
  targeting sequence with TTCN PAM
aaugaccugcagugaaggag

SEQ ID NO: 27040 - RNA, 20 nt, Artificial Sequence
  targeting sequence with TTCN PAM
aagguaacacauacuuuaug

SEQ ID NO: 27041 - RNA, 20 nt, Artificial Sequence
  targeting sequence with TTCN PAM
aaaccauuucaaaugaccug

SEQ ID NO: 27042 - RNA, 20 nt, Artificial Sequence
  targeting sequence with TTCN PAM
guguagcaaagcauaaagua

SEQ ID NO: 27043 - RNA, 20 nt, Artificial Sequence
  targeting sequence with TTCN PAM
acaguucuauucuuaaaguu

SEQ ID NO: 27044 - RNA, 20 nt, Artificial Sequence
  targeting sequence with TTCN PAM
auucuuaaaguuauuucuuu

SEQ ID NO: 27045 - RNA, 20 nt, Artificial Sequence
  targeting sequence with TTCN PAM
uaaaguuauuucuuucuugu

SEQ ID NO: 27046 - RNA, 20 nt, Artificial Sequence
  targeting sequence with TTCN PAM
uucuugugcuucuauuuuau

SEQ ID NO: 27047 - RNA, 20 nt, Artificial Sequence
  targeting sequence with TTCN PAM
ugugcuucuauuuuauaagg

SEQ ID NO: 27048 - RNA, 20 nt, Artificial Sequence
  targeting sequence with TTCN PAM
auuuuauaaggagcaacauu

SEQ ID NO: 27049 - RNA, 20 nt, Artificial Sequence
  targeting sequence with TTCN PAM
aaccaccuacuaagggaauu

SEQ ID NO: 27050 - RNA, 20 nt, Artificial Sequence
  targeting sequence with TTCN PAM
cuuaguaggugguuggaaaa

SEQ ID NO: 27051 - RNA, 20 nt, Artificial Sequence
  targeting sequence with TTCN PAM
cacucaaaacaaaucuuucu

SEQ ID NO: 27052 - RNA, 20 nt, Artificial Sequence
  targeting sequence with TTCN PAM
uguccuauagugagaauaaa

SEQ ID NO: 27053 - RNA, 20 nt, Artificial Sequence
  targeting sequence with TTCN PAM
ccuaacuccaagauuacgac

SEQ ID NO: 27054 - RNA, 20 nt, Artificial Sequence
  targeting sequence with TTCN PAM
aacuguccucaccuacacga

SEQ ID NO: 27055 - RNA, 20 nt, Artificial Sequence
  targeting sequence with TTCN PAM
uccuaccuaugaguuaaaaa

SEQ ID NO: 27056 - RNA, 20 nt, Artificial Sequence
  targeting sequence with TTCN PAM
ucauuuccuuuguuucaauu

SEQ ID NO: 27057 - RNA, 20 nt, Artificial Sequence
  targeting sequence with TTCN PAM
uuuccuuuguuucaauucua

SEQ ID NO: 27058 - RNA, 20 nt, Artificial Sequence
  targeting sequence with TTCN PAM
uuuguuucaauucuaccucu

SEQ ID NO: 27059 - RNA, 20 nt, Artificial Sequence
  targeting sequence with TTCN PAM
auucuaccucucaaagucca

SEQ ID NO: 27060 - RNA, 20 nt, Artificial Sequence
  targeting sequence with TTCN PAM
accucucaaaguccacucuu

SEQ ID NO: 27061 - RNA, 20 nt, Artificial Sequence
  targeting sequence with TTCN PAM
uaucuuaaaaugaccuuacu

SEQ ID NO: 27062 - RNA, 20 nt, Artificial Sequence
  targeting sequence with TTCN PAM
guguuugugagacuagcccg

SEQ ID NO: 27063 - RNA, 20 nt, Artificial Sequence
  targeting sequence with TTCN PAM
aguaucuccaugcuuucauc

SEQ ID NO: 27064 - RNA, 20 nt, Artificial Sequence
  targeting sequence with TTCN PAM
uccauguuauuuuucauacu

SEQ ID NO: 27065 - RNA, 20 nt, Artificial Sequence
  targeting sequence with TTCN PAM
uacuugcaaugauagccuuc

SEQ ID NO: 27066 - RNA, 20 nt, Artificial Sequence
  targeting sequence with TTCN PAM
ucuucaacauuacaaauaga

SEQ ID NO: 27067 - RNA, 20 nt, Artificial Sequence
  targeting sequence with TTCN PAM
ucaacauuacaaauagagaa

SEQ ID NO: 27068 - RNA, 20 nt, Artificial Sequence
  targeting sequence with TTCN PAM
acauuacaaauagagaacac

SEQ ID NO: 27069 - RNA, 20 nt, Artificial Sequence
  targeting sequence with TTCN PAM
cuauuuguaauguugaagaa

SEQ ID NO: 27070 - RNA, 20 nt, Artificial Sequence
  targeting sequence with TTCN PAM
acagucaccuauucucuucc

SEQ ID NO: 27071 - RNA, 20 nt, Artificial Sequence
  targeting sequence with TTCN PAM
cuuccuucuuuauauuucca

SEQ ID NO: 27072 - RNA, 20 nt, Artificial Sequence
  targeting sequence with TTCN PAM
uucuuuauauuuccauaaua

SEQ ID NO: 27073 - RNA, 20 nt, Artificial Sequence
  targeting sequence with TTCN PAM
uuauauuuccauaauacaaa

SEQ ID NO: 27074 - RNA, 20 nt, Artificial Sequence
  targeting sequence with TTCN PAM
auaauacaaaccauauggcc

SEQ ID NO: 27075 - RNA, 20 nt, Artificial Sequence
  targeting sequence with TTCN PAM
auagcuaguuuuccuguuuu

SEQ ID NO: 27076 - RNA, 20 nt, Artificial Sequence
  targeting sequence with TTCN PAM
uguuuuccucuuuccacacu

SEQ ID NO: 27077 - RNA, 20 nt, Artificial Sequence
  targeting sequence with TTCN PAM
ucuuuccacacuggcuucuu

SEQ ID NO: 27078 - RNA, 20 nt, Artificial Sequence
  targeting sequence with TTCN PAM
acacuggcuucuugaagugc

SEQ ID NO: 27079 - RNA, 20 nt, Artificial Sequence
  targeting sequence with TTCN PAM
ugaagugccauaucaaaucu

SEQ ID NO: 27080 - RNA, 20 nt, Artificial Sequence
  targeting sequence with TTCN PAM
agaagccaguguggaaagag

SEQ ID NO: 27081 - RNA, 20 nt, Artificial Sequence
  targeting sequence with TTCN PAM
uuaacaauaccauuaguauu

SEQ ID NO: 27082 - RNA, 20 nt, Artificial Sequence
  targeting sequence with TTCN PAM
auaaaugcuaauucagugau

SEQ ID NO: 27083 - RNA, 20 nt, Artificial Sequence
  targeting sequence with TTCN PAM
gugauagguuuaaaucuguc

SEQ ID NO: 27084 - RNA, 20 nt, Artificial Sequence
  targeting sequence with TTCN PAM
acccacaccagguuaggacu

SEQ ID NO: 27085 - RNA, 20 nt, Artificial Sequence
  targeting sequence with TTCN PAM
uuacucugguagaguuacau

SEQ ID NO: 27086 - RNA, 20 nt, Artificial Sequence
  targeting sequence with TTCN PAM
uucuuuacucugguagaguu

SEQ ID NO: 27087 - RNA, 20 nt, Artificial Sequence
  targeting sequence with TTCN PAM
guuauuugcuuggcuauaug

SEQ ID NO: 27088 - RNA, 20 nt, Artificial Sequence
  targeting sequence with TTCN PAM
guggcuucaguuauuugcuu

SEQ ID NO: 27089 - RNA, 20 nt, Artificial Sequence
  targeting sequence with TTCN PAM
caacacuucccaguucaucc

SEQ ID NO: 27090 - RNA, 20 nt, Artificial Sequence
  targeting sequence with TTCN PAM
caguucauccuaucugguga

SEQ ID NO: 27091 - RNA, 20 nt, Artificial Sequence
  targeting sequence with TTCN PAM
uccuaucuggugacugcauu

SEQ ID NO: 27092 - RNA, 20 nt, Artificial Sequence
  targeting sequence with TTCN PAM
agaaacugacuuuaaggcca

SEQ ID NO: 27093 - RNA, 20 nt, Artificial Sequence
  targeting sequence with TTCN PAM
ugaaaauaagccaaugcagu

SEQ ID NO: 27094 - RNA, 20 nt, Artificial Sequence
  targeting sequence with TTCN PAM
acuauggccuuaaagucagu

SEQ ID NO: 27095 - RNA, 20 nt, Artificial Sequence
  targeting sequence with TTCN PAM
ggucuuauuuuuuaaaaacu

SEQ ID NO: 27096 - RNA, 20 nt, Artificial Sequence
  targeting sequence with TTCN PAM
aaagaugacgacagaugaag

SEQ ID NO: 27097 - RNA, 20 nt, Artificial Sequence
  targeting sequence with TTCN PAM
ucugucgucaucuuuagaau

SEQ ID NO: 27098 - RNA, 20 nt, Artificial Sequence
  targeting sequence with TTCN PAM
agcguuuguaugccacaaac

SEQ ID NO: 27099 - RNA, 20 nt, Artificial Sequence
  targeting sequence with TTCN PAM
aacuucuagaagaguaacau

SEQ ID NO: 27100 - RNA, 20 nt, Artificial Sequence
  targeting sequence with TTCN PAM
agaagaguaacauauuuauu

SEQ ID NO: 27101 - RNA, 20 nt, Artificial Sequence
  targeting sequence with TTCN PAM
agaaguuagaagccucuguu

SEQ ID NO: 27102 - RNA, 20 nt, Artificial Sequence
  targeting sequence with TTCN PAM
uggcacguauuaggcacaca

SEQ ID NO: 27103 - RNA, 20 nt, Artificial Sequence
  targeting sequence with TTCN PAM
uguacaucaagauacuuccc

SEQ ID NO: 27104 - RNA, 20 nt, Artificial Sequence
  targeting sequence with TTCN PAM
cauagauguucuaaaacauu

SEQ ID NO: 27105 - RNA, 20 nt, Artificial Sequence
  targeting sequence with TTCN PAM
aaaacauuuaaaauauuaau

SEQ ID NO: 27106 - RNA, 20 nt, Artificial Sequence
  targeting sequence with TTCN PAM
aaggaaaucccuguguuaca

SEQ ID NO: 27107 - RNA, 20 nt, Artificial Sequence
  targeting sequence with TTCN PAM
uuagaaugugagccuuaaau

SEQ ID NO: 27108 - RNA, 20 nt, Artificial Sequence
  targeting sequence with TTCN PAM
uguaacacagggauuuccuu

SEQ ID NO: 27109 - RNA, 20 nt, Artificial Sequence
  targeting sequence with TTCN PAM
ccccucugccugccuguuuu

SEQ ID NO: 27110 - RNA, 20 nt, Artificial Sequence
  targeting sequence with TTCN PAM
ugcuuguaugguuuuucccc

SEQ ID NO: 27111 - RNA, 20 nt, Artificial Sequence
  targeting sequence with TTCN PAM
uuccugcuuguaugguuuuu

SEQ ID NO: 27112 - RNA, 20 nt, Artificial Sequence
  targeting sequence with TTCN PAM
aaauucuuuccugcuuguau

SEQ ID NO: 27113 - RNA, 20 nt, Artificial Sequence
  targeting sequence with TTCN PAM
aaacaauuuacucuuccuuu

SEQ ID NO: 27114 - RNA, 20 nt, Artificial Sequence
  targeting sequence with TTCN PAM
uuuucuggcuaugaaaauuc

SEQ ID NO: 27115 - RNA, 20 nt, Artificial Sequence
  targeting sequence with TTCN PAM
ggcuaugaaaauucgcauac

SEQ ID NO: 27116 - RNA, 20 nt, Artificial Sequence
  targeting sequence with TTCN PAM
uagccagaaaaggaagagua

SEQ ID NO: 27117 - RNA, 20 nt, Artificial Sequence
  targeting sequence with TTCN PAM
cauacuauuguuuaccaaua

SEQ ID NO: 27118 - RNA, 20 nt, Artificial Sequence
  targeting sequence with TTCN PAM
acccaaauuucaugacccaa

SEQ ID NO: 27119 - RNA, 20 nt, Artificial Sequence
  targeting sequence with TTCN PAM
ugacccaacaguuuggaaaa

SEQ ID NO: 27120 - RNA, 20 nt, Artificial Sequence
  targeting sequence with TTCN PAM
aaacuguugggucaugaaau

SEQ ID NO: 27121 - RNA, 20 nt, Artificial Sequence
  targeting sequence with TTCN PAM
uuuuuuccaaacuguugggu

SEQ ID NO: 27122 - RNA, 20 nt, Artificial Sequence
  targeting sequence with TTCN PAM
uggcagaaaaaaauuaucug

SEQ ID NO: 27123 - RNA, 20 nt, Artificial Sequence
  targeting sequence with TTCN PAM
gccaggaauaauguucauuu

SEQ ID NO: 27124 - RNA, 20 nt, Artificial Sequence
  targeting sequence with TTCN PAM
cagauggcucugcaugugau

SEQ ID NO: 27125 - RNA, 20 nt, Artificial Sequence
  targeting sequence with TTCN PAM
uuuuuugcuuagacauuuau

SEQ ID NO: 27126 - RNA, 20 nt, Artificial Sequence
  targeting sequence with TTCN PAM
aguauuguuucuuuuuuugc

SEQ ID NO: 27127 - RNA, 20 nt, Artificial Sequence
  targeting sequence with TTCN PAM
ugaggagucuuuaucaaauu

SEQ ID NO: 27128 - RNA, 20 nt, Artificial Sequence
  targeting sequence with TTCN PAM
ccauguuggccaggcugguc

SEQ ID NO: 27129 - RNA, 20 nt, Artificial Sequence
  targeting sequence with TTCN PAM
aaagugcuaggauuacaggc

SEQ ID NO: 27130 - RNA, 20 nt, Artificial Sequence
  targeting sequence with TTCN PAM
auggaaccuuucaucaaagg

SEQ ID NO: 27131 - RNA, 20 nt, Artificial Sequence
  targeting sequence with TTCN PAM
auugaaacagcuaggcuggg

SEQ ID NO: 27132 - RNA, 20 nt, Artificial Sequence
  targeting sequence with TTCN PAM
ucaaaggaucucaaaacaaa

SEQ ID NO: 27133 - RNA, 20 nt, Artificial Sequence
  targeting sequence with TTCN PAM
guagccauagggucaccaau

SEQ ID NO: 27134 - RNA, 20 nt, Artificial Sequence
  targeting sequence with TTCN PAM
uucuguagccauagggucac

SEQ ID NO: 27135 - RNA, 20 nt, Artificial Sequence
  targeting sequence with TTCN PAM
uuaggucauugauauauuuc

SEQ ID NO: 27136 - RNA, 20 nt, Artificial Sequence
  targeting sequence with TTCN PAM
auacugauauucugaaaccc

SEQ ID NO: 27137 - RNA, 20 nt, Artificial Sequence
  targeting sequence with TTCN PAM
gaaacccagcccucuguucu

SEQ ID NO: 27138 - RNA, 20 nt, Artificial Sequence
  targeting sequence with TTCN PAM
gaauaucaguauugaauucc

SEQ ID NO: 27139 - RNA, 20 nt, Artificial Sequence
  targeting sequence with TTCN PAM
aaaaacaaaaucuaguuuua

SEQ ID NO: 27140 - RNA, 20 nt, Artificial Sequence
  targeting sequence with TTCN PAM
uauagcacacuacuauacau

SEQ ID NO: 27141 - RNA, 20 nt, Artificial Sequence
  targeting sequence with TTCN PAM
uggcagagcuccuaaaaccc

SEQ ID NO: 27142 - RNA, 20 nt, Artificial Sequence
  targeting sequence with TTCN PAM
ucaauaacagaagcgcuuuu

SEQ ID NO: 27143 - RNA, 20 nt, Artificial Sequence
  targeting sequence with TTCN PAM
guuauugaggaaaaccuaag

SEQ ID NO: 27144 - RNA, 20 nt, Artificial Sequence
  targeting sequence with TTCN PAM
uaauguauuccuuucaacca

SEQ ID NO: 27145 - RNA, 20 nt, Artificial Sequence
  targeting sequence with TTCN PAM
uuucaaccacaccugaguuu

SEQ ID NO: 27146 - RNA, 20 nt, Artificial Sequence
  targeting sequence with TTCN PAM
accacaccugaguuuauacu

SEQ ID NO: 27147 - RNA, 20 nt, Artificial Sequence
  targeting sequence with TTCN PAM
ggauagggcugguugccagg

SEQ ID NO: 27148 - RNA, 20 nt, Artificial Sequence
  targeting sequence with TTCN PAM
ccuggcaaccagcccuaucc

SEQ ID NO: 27149 - RNA, 20 nt, Artificial Sequence
  targeting sequence with TTCN PAM
aauacucuaaucgcuugguu

SEQ ID NO: 27150 - RNA, 20 nt, Artificial Sequence
  targeting sequence with TTCN PAM
ccaaagguugaggaguggag

SEQ ID NO: 27151 - RNA, 20 nt, Artificial Sequence
  targeting sequence with TTCN PAM
ucucucuuccccaaagguug

SEQ ID NO: 27152 - RNA, 20 nt, Artificial Sequence
  targeting sequence with TTCN PAM
aaaccccaucauuuagucag

SEQ ID NO: 27153 - RNA, 20 nt, Artificial Sequence
  targeting sequence with TTCN PAM
cagguagugaauacauggag

SEQ ID NO: 27154 - RNA, 20 nt, Artificial Sequence
  targeting sequence with TTCN PAM
cuaccugggaaucuuuccaa

SEQ ID NO: 27155 - RNA, 20 nt, Artificial Sequence
  targeting sequence with TTCN PAM
uguccucucugggcacaaaa

SEQ ID NO: 27156 - RNA, 20 nt, Artificial Sequence
  targeting sequence with TTCN PAM
uuuagcuguuccugaguugu

SEQ ID NO: 27157 - RNA, 20 nt, Artificial Sequence
  targeting sequence with TTCN PAM
ugaguuguacccuuuauaau

SEQ ID NO: 27158 - RNA, 20 nt, Artificial Sequence
  targeting sequence with TTCN PAM
ugaguucuaugagucuuucc

SEQ ID NO: 27159 - RNA, 20 nt, Artificial Sequence
  targeting sequence with TTCN PAM
augagucuuuccagugaauu

SEQ ID NO: 27160 - RNA, 20 nt, Artificial Sequence
  targeting sequence with TTCN PAM
agugaauuaacgaaccugag

SEQ ID NO: 27161 - RNA, 20 nt, Artificial Sequence
  targeting sequence with TTCN PAM
cuggaaagacucauagaacu

SEQ ID NO: 27162 - RNA, 20 nt, Artificial Sequence
  targeting sequence with TTCN PAM
uuaauucacuggaaagacuc

SEQ ID NO: 27163 - RNA, 20 nt, Artificial Sequence
  targeting sequence with TTCN PAM
ucagguucguuaauucacug

SEQ ID NO: 27164 - RNA, 20 nt, Artificial Sequence
  targeting sequence with TTCN PAM
cgugaccccuuccucagguu

SEQ ID NO: 27165 - RNA, 20 nt, Artificial Sequence
  targeting sequence with TTCN PAM
gggguucucgugaccccuuc

SEQ ID NO: 27166 - RNA, 20 nt, Artificial Sequence
  targeting sequence with TTCN PAM
gucuggcuuggcugcaaauu

SEQ ID NO: 27167 - RNA, 20 nt, Artificial Sequence
  targeting sequence with TTCN PAM
gacacugucuaccuggaguu

SEQ ID NO: 27168 - RNA, 20 nt, Artificial Sequence
  targeting sequence with TTCN PAM
auucugacacugucuaccug

SEQ ID NO: 27169 - RNA, 20 nt, Artificial Sequence
  targeting sequence with TTCN PAM
auucaauucugacacugucu

SEQ ID NO: 27170 - RNA, 20 nt, Artificial Sequence
  targeting sequence with TTCN PAM
acaauuccauucaauucuga

SEQ ID NO: 27171 - RNA, 20 nt, Artificial Sequence
  targeting sequence with TTCN PAM
augacacugaguguucaaca

SEQ ID NO: 27172 - RNA, 20 nt, Artificial Sequence
  targeting sequence with TTCN PAM
guucuaugacacugaguguu

SEQ ID NO: 27173 - RNA, 20 nt, Artificial Sequence
  targeting sequence with TTCN PAM
ccuucaguucuaugacacug

SEQ ID NO: 27174 - RNA, 20 nt, Artificial Sequence
  targeting sequence with TTCN PAM
auaccacaccuaauucaccu

SEQ ID NO: 27175 - RNA, 20 nt, Artificial Sequence
  targeting sequence with TTCN PAM
ugggauauauuuguaaagcu

SEQ ID NO: 27176 - RNA, 20 nt, Artificial Sequence
  targeting sequence with TTCN PAM
auuuguacaugugcaucaag

SEQ ID NO: 27177 - RNA, 20 nt, Artificial Sequence
  targeting sequence with TTCN PAM
ugacagcauugcuuacauuu

SEQ ID NO: 27178 - RNA, 20 nt, Artificial Sequence
  targeting sequence with TTCN PAM
cucuuuuagcccaggcugga

SEQ ID NO: 27179 - RNA, 20 nt, Artificial Sequence
  targeting sequence with TTCN PAM
agugauucuccugccucagc

SEQ ID NO: 27180 - RNA, 20 nt, Artificial Sequence
  targeting sequence with TTCN PAM
ccugccucagccucccaagu

SEQ ID NO: 27181 - RNA, 20 nt, Artificial Sequence
  targeting sequence with TTCN PAM
cgacauucgccaggcugguc

SEQ ID NO: 27182 - RNA, 20 nt, Artificial Sequence
  targeting sequence with TTCN PAM
ccaggcuggucuugaacucc

SEQ ID NO: 27183 - RNA, 20 nt, Artificial Sequence
  targeting sequence with TTCN PAM
agaccagccuggcgaauguc

SEQ ID NO: 27184 - RNA, 20 nt, Artificial Sequence
  targeting sequence with TTCN PAM
guuacuucuccugcaaacuu

SEQ ID NO: 27185 - RNA, 20 nt, Artificial Sequence
  targeting sequence with TTCN PAM
ccugcaaacuuguuucucuu

SEQ ID NO: 27186 - RNA, 20 nt, Artificial Sequence
  targeting sequence with TTCN PAM
cuuucuuucagucuucucca

SEQ ID NO: 27187 - RNA, 20 nt, Artificial Sequence
  targeting sequence with TTCN PAM
uucagucuucuccaucucaa

SEQ ID NO: 27188 - RNA, 20 nt, Artificial Sequence
  targeting sequence with TTCN PAM
gucuucuccaucucaauaaa

SEQ ID NO: 27189 - RNA, 20 nt, Artificial Sequence
  targeting sequence with TTCN PAM
ccaucucaauaaaugacaac

SEQ ID NO: 27190 - RNA, 20 nt, Artificial Sequence
  targeting sequence with TTCN PAM
uccagaaacucaauacaaaa

SEQ ID NO: 27191 - RNA, 20 nt, Artificial Sequence
  targeting sequence with TTCN PAM
agaaacucaauacaaaaacc

SEQ ID NO: 27192 - RNA, 20 nt, Artificial Sequence
  targeting sequence with TTCN PAM
ggaagaaugcaguugucauu

SEQ ID NO: 27193 - RNA, 20 nt, Artificial Sequence
  targeting sequence with TTCN PAM
uuucuuucacagcacauauc

SEQ ID NO: 27194 - RNA, 20 nt, Artificial Sequence
  targeting sequence with TTCN PAM
uucacagcacauauccaauc

SEQ ID NO: 27195 - RNA, 20 nt, Artificial Sequence
  targeting sequence with TTCN PAM
cagcacauauccaaucuauc

SEQ ID NO: 27196 - RNA, 20 nt, Artificial Sequence
  targeting sequence with TTCN PAM
aguagagucagcagguuuug

SEQ ID NO: 27197 - RNA, 20 nt, Artificial Sequence
  targeting sequence with TTCN PAM
ggauauauuuuucaaguaga

SEQ ID NO: 27198 - RNA, 20 nt, Artificial Sequence
  targeting sequence with TTCN PAM
cucaccuugauuacaguaau

SEQ ID NO: 27199 - RNA, 20 nt, Artificial Sequence
  targeting sequence with TTCN PAM
gcuuuuguccuugcccaauc

SEQ ID NO: 27200 - RNA, 20 nt, Artificial Sequence
  targeting sequence with TTCN PAM
uuggcugcugaguagauagu

SEQ ID NO: 27201 - RNA, 20 nt, Artificial Sequence
  targeting sequence with TTCN PAM
uuucuuuggcugcugaguag

SEQ ID NO: 27202 - RNA, 20 nt, Artificial Sequence
  targeting sequence with TTCN PAM
uauuuugcucaguguaaaug

SEQ ID NO: 27203 - RNA, 20 nt, Artificial Sequence
  targeting sequence with TTCN PAM
gcauuuacacugagcaaaau

SEQ ID NO: 27204 - RNA, 20 nt, Artificial Sequence
  targeting sequence with TTCN PAM
aauaagcucccaggugcugc

SEQ ID NO: 27205 - RNA, 20 nt, Artificial Sequence
  targeting sequence with TTCN PAM
uaggucugggguagggccua

SEQ ID NO: 27206 - RNA, 20 nt, Artificial Sequence
  targeting sequence with TTCN PAM
auuaaaauuuagacucuaau

SEQ ID NO: 27207 - RNA, 20 nt, Artificial Sequence
  targeting sequence with TTCN PAM
ugugcacauugaaguuugaa

SEQ ID NO: 27208 - RNA, 20 nt, Artificial Sequence
  targeting sequence with TTCN PAM
augugcacaugaauuaccuu

SEQ ID NO: 27209 - RNA, 20 nt, Artificial Sequence
  targeting sequence with TTCN PAM
aacuucaaugugcacaugaa

SEQ ID NO: 27210 - RNA, 20 nt, Artificial Sequence
  targeting sequence with TTCN PAM
auaaagcaccacaaaauaag

SEQ ID NO: 27211 - RNA, 20 nt, Artificial Sequence
  targeting sequence with TTCN PAM
ucaggcaagcuucugucuca

SEQ ID NO: 27212 - RNA, 20 nt, Artificial Sequence
  targeting sequence with TTCN PAM
gucucaggacauguacacug

SEQ ID NO: 27213 - RNA, 20 nt, Artificial Sequence
  targeting sequence with TTCN PAM
cuaugccuagaaugcucuuc

SEQ ID NO: 27214 - RNA, 20 nt, Artificial Sequence
  targeting sequence with TTCN PAM
aggcauagugaaucacagug

SEQ ID NO: 27215 - RNA, 20 nt, Artificial Sequence
  targeting sequence with TTCN PAM
cauauauguguauggcucac

SEQ ID NO: 27216 - RNA, 20 nt, Artificial Sequence
  targeting sequence with TTCN PAM
cuucuuucaagcccuuacuc

SEQ ID NO: 27217 - RNA, 20 nt, Artificial Sequence
  targeting sequence with TTCN PAM
uucaagcccuuacucaaaug

SEQ ID NO: 27218 - RNA, 20 nt, Artificial Sequence
  targeting sequence with TTCN PAM
agacguuugauauaggcugg

SEQ ID NO: 27219 - RNA, 20 nt, Artificial Sequence
  targeting sequence with TTCN PAM
ucaguacaggaaguaaauua

SEQ ID NO: 27220 - RNA, 20 nt, Artificial Sequence
  targeting sequence with TTCN PAM
uguacugaugaauuugccug

SEQ ID NO: 27221 - RNA, 20 nt, Artificial Sequence
  targeting sequence with TTCN PAM
ccccugcaguccuugguaac

SEQ ID NO: 27222 - RNA, 20 nt, Artificial Sequence
  targeting sequence with TTCN PAM
cccuuccccccugcaguccu

SEQ ID NO: 27223 - RNA, 20 nt, Artificial Sequence
  targeting sequence with TTCN PAM
gaguuuuuguuuggggugau

SEQ ID NO: 27224 - RNA, 20 nt, Artificial Sequence
  targeting sequence with TTCN PAM
ucaccccaaacaaaaacucu

SEQ ID NO: 27225 - RNA, 20 nt, Artificial Sequence
  targeting sequence with TTCN PAM
auaauguuucaucaccccaa

SEQ ID NO: 27226 - RNA, 20 nt, Artificial Sequence
  targeting sequence with TTCN PAM
gcggcguuaaguacauccac

SEQ ID NO: 27227 - RNA, 20 nt, Artificial Sequence
  targeting sequence with TTCN PAM
auucagcggcguuaaguaca

SEQ ID NO: 27228 - RNA, 20 nt, Artificial Sequence
  targeting sequence with TTCN PAM
ugguguuuugaacaaagaau

SEQ ID NO: 27229 - RNA, 20 nt, Artificial Sequence
  targeting sequence with TTCN PAM
aaacaccaagaaccuggaca

SEQ ID NO: 27230 - RNA, 20 nt, Artificial Sequence
  targeting sequence with TTCN PAM
uuguucaaaacaccaagaac

SEQ ID NO: 27231 - RNA, 20 nt, Artificial Sequence
  targeting sequence with TTCN PAM
auucuuuguucaaaacacca

SEQ ID NO: 27232 - RNA, 20 nt, Artificial Sequence
  targeting sequence with TTCN PAM
cugcuuugcugggcguuuug

SEQ ID NO: 27233 - RNA, 20 nt, Artificial Sequence
  targeting sequence with TTCN PAM
uuuucucugcuuugcugggc

SEQ ID NO: 27234 - RNA, 20 nt, Artificial Sequence
  targeting sequence with TTCN PAM
uuuguugcuucauuuucucu

SEQ ID NO: 27235 - RNA, 20 nt, Artificial Sequence
  targeting sequence with TTCN PAM
auaaaucccugcuuuuguuc

SEQ ID NO: 27236 - RNA, 20 nt, Artificial Sequence
  targeting sequence with TTCN PAM
uuuucaauaaaucccugcuu

SEQ ID NO: 27237 - RNA, 20 nt, Artificial Sequence
  targeting sequence with TTCN PAM
guauggcuggcccuugagcc

SEQ ID NO: 27238 - RNA, 20 nt, Artificial Sequence
  targeting sequence with TTCN PAM
ugggucaaaauacccucuag

SEQ ID NO: 27239 - RNA, 20 nt, Artificial Sequence
  targeting sequence with TTCN PAM
agaggguauuuugacccaag

SEQ ID NO: 27240 - RNA, 20 nt, Artificial Sequence
  targeting sequence with TTCN PAM
cacugggcacuucaugcuua

SEQ ID NO: 27241 - RNA, 20 nt, Artificial Sequence
  targeting sequence with TTCN PAM
ugcuuaccucauguaaauga

SEQ ID NO: 27242 - RNA, 20 nt, Artificial Sequence
  targeting sequence with TTCN PAM
uuuacaugagguaagcauga

SEQ ID NO: 27243 - RNA, 20 nt, Artificial Sequence
  targeting sequence with TTCN PAM
cccuagccucugauugguug

SEQ ID NO: 27244 - RNA, 20 nt, Artificial Sequence
  targeting sequence with TTCN PAM
augcaaaagaagacucagcu

SEQ ID NO: 27245 - RNA, 20 nt, Artificial Sequence
  targeting sequence with TTCN PAM
uuugcauagaaguauaacuu

SEQ ID NO: 27246 - RNA, 20 nt, Artificial Sequence
  targeting sequence with TTCN PAM
gaggcuggagugaaguuaca

SEQ ID NO: 27247 - RNA, 20 nt, Artificial Sequence
  targeting sequence with TTCN PAM
cuccagccucugaaugguug

SEQ ID NO: 27248 - RNA, 20 nt, Artificial Sequence
  targeting sequence with TTCN PAM
caacuuuguaacuucacucc

SEQ ID NO: 27249 - RNA, 20 nt, Artificial Sequence
  targeting sequence with TTCN PAM
uucgcaacuuuguaacuuca

SEQ ID NO: 27250 - RNA, 20 nt, Artificial Sequence
  targeting sequence with TTCN PAM
caucugcuguccagaaaagg

SEQ ID NO: 27251 - RNA, 20 nt, Artificial Sequence
  targeting sequence with TTCN PAM
ggacagcagaugggaaauug

SEQ ID NO: 27252 - RNA, 20 nt, Artificial Sequence
  targeting sequence with TTCN PAM
augccuaaguaaaaaacgac

SEQ ID NO: 27253 - RNA, 20 nt, Artificial Sequence
  targeting sequence with TTCN PAM
uuucaaguuaguucaaggaa

SEQ ID NO: 27254 - RNA, 20 nt, Artificial Sequence
  targeting sequence with TTCN PAM
aguuaguucaaggaagucgg

SEQ ID NO: 27255 - RNA, 20 nt, Artificial Sequence
  targeting sequence with TTCN PAM
aggaagucggagugaggcau

SEQ ID NO: 27256 - RNA, 20 nt, Artificial Sequence
  targeting sequence with TTCN PAM
uugaacuaacuugaaaggaa

SEQ ID NO: 27257 - RNA, 20 nt, Artificial Sequence
  targeting sequence with TTCN PAM
cugccugcagacucuauucu

SEQ ID NO: 27258 - RNA, 20 nt, Artificial Sequence
  targeting sequence with TTCN PAM
ccugccuccuauguuuuacu

SEQ ID NO: 27259 - RNA, 20 nt, Artificial Sequence
  targeting sequence with TTCN PAM
uuuucuuucuuuuuuuuuuu

SEQ ID NO: 27260 - RNA, 20 nt, Artificial Sequence
  targeting sequence with TTCN PAM
uucuuuuuuuuuuuuuuuuu

SEQ ID NO: 27261 - RNA, 20 nt, Artificial Sequence
  targeting sequence with TTCN PAM
uuuuuuuuuuuuuuuuuuug

SEQ ID NO: 27262 - RNA, 20 nt, Artificial Sequence
  targeting sequence with TTCN PAM
gucuccaggcuggagugcag

SEQ ID NO: 27263 - RNA, 20 nt, Artificial Sequence
  targeting sequence with TTCN PAM
cagguucaagugauucuccu

SEQ ID NO: 27264 - RNA, 20 nt, Artificial Sequence
  targeting sequence with TTCN PAM
agugauucuccugccucagc

SEQ ID NO: 27265 - RNA, 20 nt, Artificial Sequence
  targeting sequence with TTCN PAM
ccugccucagccucccgagu

SEQ ID NO: 27266 - RNA, 20 nt, Artificial Sequence
  targeting sequence with TTCN PAM
ucugggccucacucaccgga

SEQ ID NO: 27267 - RNA, 20 nt, Artificial Sequence
  targeting sequence with TTCN PAM
cagcagagggagcagccaug

SEQ ID NO: 27268 - RNA, 20 nt, Artificial Sequence
  targeting sequence with TTCN PAM
ccucccaauauccacacagu

SEQ ID NO: 27269 - RNA, 20 nt, Artificial Sequence
  targeting sequence with TTCN PAM
ggccuuugcucaaugucccu

SEQ ID NO: 27270 - RNA, 20 nt, Artificial Sequence
  targeting sequence with TTCN PAM
cuggccaccuauugaaaccc

SEQ ID NO: 27271 - RNA, 20 nt, Artificial Sequence
  targeting sequence with TTCN PAM
auagguggccagggaaggcc

SEQ ID NO: 27272 - RNA, 20 nt, Artificial Sequence
  targeting sequence with TTCN PAM
cuggcugcccucagcuacgu

SEQ ID NO: 27273 - RNA, 20 nt, Artificial Sequence
  targeting sequence with TTCN PAM
cguaauuugagcuuuaggaa

SEQ ID NO: 27274 - RNA, 20 nt, Artificial Sequence
  targeting sequence with TTCN PAM
uaaagcucaaauuacgugaa

SEQ ID NO: 27275 - RNA, 19 nt, Artificial Sequence
  targeting sequence
aaguggcugcguaccacac

SEQ ID NO: 27276 - RNA, 18 nt, Artificial Sequence
  targeting sequence
aaguggcugcguaccaca

SEQ ID NO: 27277 - RNA, 17 nt, Artificial Sequence
  targeting sequence
aaguggcugcguaccac

SEQ ID NO: 27278 - RNA, 16 nt, Artificial Sequence
  targeting sequence
aaguggcugcguacca

SEQ ID NO: 27279 - RNA, 15 nt, Artificial Sequence
  targeting sequence
aaguggcugcguacc

SEQ ID NO: 27280 - protein, 44 aa, Mus musculus
MNGTEGPNFYVPFSNVTGVVRSPFEQPQYYLAEPWQFSMLAAYM

SEQ ID NO: 27281 - DNA, 39 bp, Mus musculus
ttctccaacgtcacaggcgtggtgcggagccccttcgag

SEQ ID NO: 27282 - DNA, 34 bp, Artificial Sequence
  mRHO target sequence
ttctccaacgtcacaggtgcggagccccttcgag

SEQ ID NO: 27283 - DNA, 34 bp, Artificial Sequence
  mRHO target sequence
ttctccaacgtcacaggcgcggagccccttcgag

SEQ ID NO: 27284 - DNA, 35 bp, Artificial Sequence
  mRHO target sequence
ttctccaacgtcacgtggtgcggagccccttcgag

SEQ ID NO: 27285 - DNA, 35 bp, Artificial Sequence
  mRHO target sequence
ttctccaacgtcacagggtgcggagccccttcgag

SEQ ID NO: 27286 - DNA, 35 bp, Artificial Sequence
  mRHO target sequence
ttctccaacgtcacatggtgcggagccccttcgag

SEQ ID NO: 27287 - DNA, 34 bp, Artificial Sequence
  mRHO target sequence
ttctccaacgtcactggtgcggagccccttcgag

SEQ ID NO: 27288 - DNA, 36 bp, Artificial Sequence
  mRHO target sequence
ttctccaacgtcacagtggtgcggagccccttcgag

SEQ ID NO: 27289 - DNA, 28 bp, Artificial Sequence
  mRHO target sequence
ttctccaacggtgcggagccccttcgag

SEQ ID NO: 27290 - DNA, 33 bp, Artificial Sequence
  mRHO target sequence
ttctccaacgtcacagtgcggagccccttcgag

SEQ ID NO: 27291 - DNA, 37 bp, Artificial Sequence
  mRHO target sequence
ttctccaacgtcacaggtggtgcggagccccttcgag

SEQ ID NO: 27292 - DNA, 36 bp, Artificial Sequence
  mRHO target sequence
ttctccaacgtcacaggcgtgcggagccccttcgag

SEQ ID NO: 27293 - DNA, 37 bp, Artificial Sequence
  mRHO target sequence
ttctccaacgtcacaggcggtgcggagccccttcgag

SEQ ID NO: 27294 - DNA, 30 bp, Artificial Sequence
  mRHO target sequence
ttctccaacgtggtgcggagccccttcgag

SEQ ID NO: 27295 - DNA, 26 bp, Artificial Sequence
  mRHO target sequence
ttctccaggtgcggagccccttcgag

SEQ ID NO: 27296 - DNA, 32 bp, Artificial Sequence
  mRHO target sequence
ttctccaacgtcaggtgcggagccccttcgag

SEQ ID NO: 27297 - DNA, 33 bp, Artificial Sequence
  mRHO target sequence
ttctccaacgtcacggtgcggagccccttcgag

SEQ ID NO: 27298 - DNA, 35 bp, Artificial Sequence
  mRHO target sequence
ttctccaacgtcgcgtggtgcggagccccttcgag

SEQ ID NO: 27299 - DNA, 27 bp, Artificial Sequence
  mRHO target sequence
ttctccatggtgcggagccccttcgag

SEQ ID NO: 27300 - DNA, 27 bp, Artificial Sequence
  mRHO target sequence
ttctccaacgtgcggagccccttcgag

SEQ ID NO: 27301 - DNA, 14 bp, Artificial Sequence
  gRNA sequence
attatctcattact
